United States Patent 9,011,834 (COMPOSITIONS AND METHODS) - sequence listing, part 2

SEQ ID NO: 1617 - DNA, 1515 bp, Raoultella ornithinolytica
cagattgaacgctggcggcacgcctaacacatgcaagtcgagcggtagcacagagagcttgctctcgggtgacgagcggcggacgggtgagtaatgtctgggaaactgcctgatggagggggataactactggaaacggtagctaataccgcataacgtcgcaagaccaaagtgggggaccttcgggcctcatgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcgttaaggttaataaccttagtgattgacgttactcgcagaagaagcaccggctaactccgtgccagcagccgcggtaatacggagggtgcaagcgttaatcggaattactgggcgtaaagcgcacgcaggcggtctgttaagtcagatgtgaaatccccgggctcaacctgggaactgcatttgaaactggcaggcttgagtcttgtagaggggggtagaattccaggtgtagcggtgaaatgcgtavagatctggaggaataccggtggcgaaggcggccccctggacaaagactgacgctcaggtgcgaaagcgtggggagcaaacaggattagataccctggtagtccacgctgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggctggatcacctcctt

SEQ ID NO: 1618 - DNA, 1398 bp, Raoultella planticola
tcgagcggtagcacagagagcttgctctcgggtgacgagcggcggacgggtgagtaatgtctgggaaactgcctgatggagggggataactactggaaacggtagctaataccgcataacgtcgcaagaccaaagtgggggaccttcgggcctcatgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcattaaggttaataaccttggtgattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatttgaaactggcaagcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggggccttcgggaactctgagacagaggctgcatggctgtcgtcagctcgtgtgatgaaattttgggattagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcg

SEQ ID NO: 1619 - DNA, 1454 bp, Raoultella terrigena
tgaacgctggcggcaggcctaacacatgcaagtcgagcggtagcacagaagagcttgctcttcgggtgacgagcggcggacgggtgagtaatgtctgggaaactgcctgatggagggggataactactggaaacggtagctaataccgcataacgtcgcaagaccaaagtgggggaccttcgggcctcatgccatcagatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcgttaaggttaataaccttagcgattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatga

SEQ ID NO: 1620 - DNA, 1432 bp, Rhodobacter sp.
  oral taxon C30
agagtttgatcctggctcagaacgaacgctggcggcaggcctaacacatgcaagtcgaacgagatcttcggatctagtggcggacgggtgagtaacgcgtgggaacgtgccctttggttcggaatagcctcgggaaactgggagtaataccggatacgcccttcgggggaaagatttatcgccaaaggatcggcccgcgttggattaggtagttggtggggtaacggcctaccaagccgacgatccatagctggtttgagaggatgatcagccacactgggactgagacacggcccagactcctacgggaggcagcagtggggaatcttagacaatgggggcaaccctgatctagccatgccgcgtgatcgatgaaggccttagggttgtaaagatctttcagctgggaagataatgactgtaccagcagaagaagccccggctaactccgtgccagcagccgcggtaatacggagggggctagcgttgttcggaattactgggcgtaaagcgcacgtaggcggaccagaaagtcagaggtgaaatcccagggctcaaccttggaactgcctttgaaactcctggtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgtcgggcagccatgctgttcggtgtcacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatggcgatcgcggttccagagatggttccttcagttcggctggatcgcacacaggtgctgcatggctgtcgtcagctcgtgtcgtgagatgttcggttaagtccggcaacgagcgcaacccacactttcagttgccatcattcagttgggcactctgaaagaactgccggtgataagccggaggaaggtgtggatgacgtcaagtcctcatggcccttacgggttgggctacacacgtgctacaatggtggtgacaatgggttaatccccaaaagccatctcagttcggattggggtctgcaactcgaccccatgaagtcggaatcgctagtaatcgcgtaacagcatgacgcggtgaatacgttcccgggccttgtacacaccgcccgtcacaccatgggaattgggtctacccgacgacggtgcgccaacctcgcaagaggaagcagccggccacggtaggctcagtgactggggtgaagtcgtaacaaggtagccgta

SEQ ID NO: 1621 - DNA, 1466 bp, Rhodobacter sphaeroides
caacttgagagtttgatcctggctcagaatgaacgctggcggcaggcctaacacatgcaagtcgagcgaagtcttcggacttagcggcggacgggtgagtaacgcgtgggaacgtgccctttgcttcggaatagccccgggaaactgggagtaataccgaatgtgccctttgggggaaagatttatcggcaaaggatcggcccgcgttggattaggtagttggtggggtaatggcctaccaagccgacgatccatagctggtttgagaggatgatcagccacactgggactgagacacggcccagactcctacgggaggcagcagtggggaatcttagacaatgggcgcaagcctgatctagccatgccgcgtgatcgatgaaggccttagggttgtaaagatctttcaggtgggaagataatgacggtaccaccagaagaagccccggctaactccgtgccagcagccgcggtaatacggagggggctagcgttattcggaattactgggcgtaaagcgcacgtaggcggatcggaaagtcagaggtgaaatcccagggctcaaccctggaactgcctttgaaactcccgatcttgaggtcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggcagcatgctgttcggtgacacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatggcgatcgcggttccagagatggttccttcagttcggctggatcgcacacaggtgctgcatggctgtcgtcagctcgtgtcgtgagatgttcggttaagtccggcaacgagcgcaacccacgtccttagttgccagcattcagttgggcactctagggaaactgccggtgataagccggaggaaggtgtggatgacgtcaagtcctcatggcccttacgggttgggctacacacgtgctacaatggcagtgacaatgggttaatcccaaaaagctgtctcagttcggattggggtctgcaactcgaccccatgaagtcggaatcgctagtaatcgcgtaacagcatgacgcggtgaatacgttcccgggccttgtacacaccgcccgtcacaccatgggaattggttctacccgaaggcggtgcgccaacctcgcaagaggaggcagccgaccacggtaggatcagtgactggggtgaagtcgtaacaaggtagccgtaggggaacctgcggctggatcacctcctt

SEQ ID NO: 1622 - DNA, 1477 bp, Rhodococcus corynebacterioides
  modified_base (970)..(970): a, c, t, g, unknown or other
  modified_base (970)..(970): a, c, t, g, unknown or other
cctggctcaggacgaacgctggcggcgtgcttaacacatgcaagtcgaacggtaaggcccttcggggtacacgagtggcgaacgggtgagtaacacgtgggtgatctgccctgcacttcgggataagcccgggaaactgggtctaataccggataggactgcgcggtgcatgccgtgtggtggaaagatttatcggtgcaggatgggcccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgcaagcctgatgcagcgacgccgcgtgagggatgacggccttcgggttgtaaacctctttcagcagggacgaagcgcaagtgacggtacctgcagaagaagcaccggccaactacgtgccagcagccgcggtaatacgtagggtgcaagcgttgtccggaattactgggcgtaaagagctcgtaggcggtttgtcgcgtcgtctgtgaaaaccagcagctcaactgttggcttgcaggcgatacgggcagacttgagtatttcaggggagactggaattcctggtgtagcggtgaaatgcgcagatatcaggaggaacaccggtggcgaaggcgggtctctgggaaataactgacgctgaggagcgaaagcgtgggtagcgaacaggattagataccctggtagtccacgccgtaaacggtgggcgctaggtgtgggtttccttccacgggatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatacaccggaaagccgtngagatacggccccccttgtggtcggtgtacaggtggtgcatggctgtcgtcagctcgtgtcgtgagatgttgggttaagtcccgcaacgagcgcaacccttgtcctgtgttgccagcacgttatggcggggactcgcaggagactgccggggtcaactcggaggaaggtggggacgacgtcaagtcatcatgccccttatgtccagggcttcacacatgctacaatggccggtacagagggctgcgataccgtgaggtggagcgaatcccttaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaaccccttgtgggagggagccgtcgaaggtgggatcggcgattgggacgaagtcgtaacaaggtagccgtaccgg

SEQ ID NO: 1623 - DNA, 1523 bp, Rhodococcus equi
cttcaacggagagtttgatcctggctcaggacgaacgctggcggcgtgcttaacacatgcaagtcgaacggtaaggccccttcgggggtacacgagtggcgaacgggtgagtaacacgtgggtgatctgccctgcactctgggataagcctgggaaactgggtctaataccggatatgagctcctgtcgcatggcgggggttggaaaggtttactggtgcaggatgggcccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgagagtgacggtacctgcagaagaagcaccggccaactacgtgccagcagccgcggtaatacgtagggtgcgagcgttgtccggaattactgggcgtaaagagctcgtaggcggtttgtcgcgtcgtccgtgaaaacttggggctcaaccccaagcttgcgggcgatacgggcagacttgagtactgcaggggagactggaattcctggtgtagcggtgaaatgcgcagatatcaggaggaacaccggtggcgaaggcgggtctctgggcagtaactgacgctgaggagcgaaagcgtgggtagcgaacaggattagataccctggtagtccacgccgtaaacggtgggcgctaggtgtgggtttccttccacgggatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagccgtagagatacggccccccttgtggtcggtatacaggtggtgcatggctgtcgtcagctcgtgtcgtgagatgttgggttaagtcccgcaacgagcgcaacccttgtcctgtgttgccagcgcgtaatggcggggactcgcaggagactgccggggtcaactcggaggaaggtggggacgacgtcaagtcatcatgccccttatgtccagggcttcacacatgctacaatggccggtacagagggctgcgataccgtgaggtggagcgaatcccttaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaacccttgtggagggagccgtcgaaggtgggatcggcgattgggacgaagtcgtaacaaggtagccgtaccggaaggtgcggctggatcacctcctttct

SEQ ID NO: 1624 - DNA, 1527 bp, Rhodococcus erythropolis
acggagagtttgatcctggctcaggacgaacgctggcggcgtgcttaacacatgcaagtcgagcggtaaggcctttcggggtacacgagcggcgaacgggtgagtaacacgtgggtgatctgccctgcacttcgggataagcctgggaaactgggtctaataccggatatgacctcaggttgcatgacttgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttccttccacggaatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcttaaccccttgtgggagggagccgtcgaaggtgggatcggcgattgggacgaagtcgtaacaaggtagccgtaccggaaggtgcggctggatcacctcctttctaaggagca

SEQ ID NO: 1625 - DNA, 1424 bp, Rhodococcus fascians
cctggctcaggacgaacgctggcggcgtgcttaacacatgcaagtcgagcggtaaggcctttcggggtacacgagcggcgaacgggtgagtaacacgtgggtgatctgccctgcactctgggataagcttgggaaactgggtctaataccggatatgaccacagcatgcatgtgttgtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcggaagcctgatgcagcgacgccgcgtgagggatgaaggccttcgggttgtaaacctctttcagcagggacgaagcgtgagtgacggtacctgcagaagaagcaccggctaactacgtgccagcagccgcggtaatacgtagggtgcgagcgttgtccggaattactgggcgtaaagagttcgtaggcggtttgtcgcgtcgtttgtgaaaacccggggctcaacttcgggcttgcaggcgatacgggcagacttgagtgtttcaggggagactggaattcctggtgtagcggtgaaatgcgcagatatcaggaggaacaccggtggcgaaggcgggtctctgggaaacaactgacgctgaggaacgaaagcgtgggtagcaaacaggattagataccctggtagtccacgccgtaaacggtgggcgctaggtgtgggttccttccacgggatctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatacaccggaaaaccgtagagatacggtcccccttgtggtcggtgtacaggtggtgcatggctgtcgtcagctcgtgtcgtgagatgttgggttaagtcccgcaacgagcgcaacccttgtcttatgttgccagcacgtaatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaaccccttacggggagggagccg

SEQ ID NO: 1626 - DNA, 1489 bp, Rhodopseudomonas palustris
tccaacttgagagtttgatcctggctcagagcgaacgctggcggcaggcttaacacatgcaagtcgaacgggcatagcaatatgtcagtggcagacgggtgagtaacgcgtgggaacataccttttggttcggaacaactgagggaaacttcagctaataccggataagccctaacggggaaagatttatcgccgaaagattggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtttttaagtcagaggtgaaatcctggagctcaactccagaactgcctttgatactgaaagtcttgagtacgggagaggtgagtggaactgcgagtgtagaggtgaaattcgtagatattcgcaagaacaccagtggcgaaggcggctcactggcccgttactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtctaggaccggtcgcagagatgtgaccttctcttcggagcctagagcacaggtgctgcatggctgtcgtcagctcgtgtcgtgagatgttgggttaagtcccgcaacgagcgcaacccccgtctttagttgctaccatttagttgagcactctaaagagactgccggtgataagccgcgaggaaggtggggatgacgtcaagtcctcatggcccttacgggctgggctacacacgtgctacaatggcggtgacaatgggatgctaaagggcaacctctcgcaaatctcaaaaagccgtctcagttcggattgggctctgcaactcgagcccatgaagttggaatcgctagtaatcgtggatcagcatgccacggtgaatacgttcccgggccttgtacacaccgcccgtcacaccatgggagttggttttacctgaaggtagtgcgctaacccgcaagggaggcagctaaccacggtagggtcagcgactggggtgaagtcgtaacaaggtagccgtaggggaacctgcggctggatcacctcct

SEQ ID NO: 1627 - DNA, 1508 bp, Rickettsia akari
gacagaatcaaacttgagagtttgatcctggctcagaacgaacgctatcggtatgcttaacacatgcaagtcggacggactgattggggttttctccagttagtgagtggcgaacgggtgagtaacacgtgggaatctgcccatcagtacggaataacttttagaaataaaagctaataccgtatattctctacggaggaaagatttatcgctgatggatgagcccgcgtcggattaggtagttggtgaggtaacggctcaccaagccgacgatctgtagttggtctgagaggatgatcagccacactgggactgagacacggcccagactcctacgggaggcagcagtggggaatattggacaatgggcgaaagcctgatccagcaataccgagtgagtgatgaaggccctagggttgtaaagctcttttagcaaggaagataatgacgttacttgcagaaaaagccccggctaactccgtgccagcagccgcggtaagacggagggggctagcgttgttcggaattactgggcgtaaagagtgcgtaggcggtttagtaagttggaagtgaaagcccggggcttaacctcggaattgctttcaaaactactaatctagagtgtagtaggggatgatggaattcctagtgtagaggtgaaattcttagatattaggaggaacaccggtggcgaaggcggtcatctgggctacgactgacgctgatgcacgaaagcgtggggagcaaacaggattagataccctggtagtccacgccgtaaacgatgagtgctagatatcggaagagtctctttcggtttcgcagctaacgcattaagcactccgcctggggagtacggtcgcaagattaaaactcaaaggaattgacgggggctcgcacaagcggtggagcatgcggtttaattcgatgttacgcgaaaaaccttaccaacctttgacatggtggttgcggatcgcagagatgctttccttcagttcggctggaccacacacaggtgttgcatggctgtcgtcagctcgtgtcgtgagatgttgggttaagtcccgcaacgagcgcaaccctcattcttatttgccagcgggtaatgccgggaactataagaaaactgccggtgataagccggaggaaggtggggacgacgtcaagtcatcatggcccttatgggttgggctacacgcgtgctacaatggtgtttacagagggaagcaagacggtaacgtggagcaaatccctaaaagacatctcagttcggattgttctctgcaactcgagagcatgaagttggaatcgctagtaatcgcggatcagcatgccgcggtgaatacgttctcgggccttgtacacactgcccgtcacgccatgggagttggttttacctgaaggtggtgagctaacgcaagaggcagccaaccacggtagaattagcgactggggtgaagtcgtaacaaggtagccgtaggggaacctgcggctggattacctcctta

SEQ ID NO: 1628 - DNA, 1501 bp, Rickettsia conorii
tcaaacttgagagtttgatcctggctcagaacgaacgctatcggtatgcttaacacatgcaagtcgaacggactaattggggcttgctccagttagttagtggcagacgggtgagtaacacgtgggaatctacccattagtacggaataacttttagaaataaaagctaataccgtatattctctgcggaggaaagatttatcgctgatggatgagcccgcgtcagattaggtagttggtgaggtaatggctcaccaagccgacgatctgtagctggtctgagaggatgatcagccacactgggactgagacacggcccagactcctacgggaggcagcagtggggaatattggacaatgggcgaaagcctgatccagcaataccgagtgagtgatgaaggccttagggttgtaaagctcttttagcaaggaagataatgacgttacttgcagaaaaagccccggctaactccgtgccagcagccgcggtaagacggagggggctagcgttgttcggaattactgggcgtaaagagtgcgtaggcggtttagtaagttggaagtgaaagcccggggcttaacctcggaattgctttcaaaactactaatctagagtgtagtaggggatgatggaattcctagtgtagaggtgaaattcttagatattaggaggaacaccggtggcgaaggcggtcatctgggctacaactgacgctgatgcacgaaagcgtggggagcaaacaggattagataccctggtagtccacgccgtaaacgatgagtgctagatatcggaagattctctttcggtttcgcagctaacgcattaagcactccgcctggggagtacggtcgcaagattaaaactcaaaggaattgacgggggctcgcacaagcggtggagcatgcggtttaattcgatgttacgcgaaaaaccttaccaacccttgacatggtggtcgcggatcgcagagatgcttttcttcagctcggctggaccacacacaggtgttgcatggctgtcgtcagctcgtgtcgtgagatgttgggttaagtcccgcaacgagcgcaaccctcattcttatttgccagcgggtaatgccgggaactataagaaaactgccggtgataagccggaggaaggtggggacgacgtcaagtcatcatggcccttacgggttgggctacacgcgtgctacaatggtgtttacagagggaagcaagacggcgacgtggagcaaatccctaaaagacatctcagttcggattgttctctgcaactcgagagcatgaagttggaatcgctagtaatcgcggatcagcatgccgcggtgaatacgttctcgggccttgtacacactgcccgtcacgccatgggagttagttttacctgaaggtggtgagctaacgcaagaggcagccaaccacggtaaaattagcgactggggtgaagtcgtaacaaggtagccgtaggggaacctgcggctggattacctcctta

SEQ ID NO: 1629 - DNA, 1501 bp, Rickettsia prowazekii
tcaaacttgagagtttgatcctggctcagaacgaacgctatcggtatgcttaacacatgcaagtcgaacggattaactagagctcgctttagttaattagtggcagacgggtgagtaacacgtgggaatctacccatcagtacggaataacttttagaaataaaagctaataccgtatattctctacggaggaaagatttatcgctgatggatgggcccgcgtcagattaggtagttggtgaggtaatggctcaccaagccgacgatctgtagctggtctgagaggatgatcagccacactgggactgagacacggcccagactcctacgggaggcagcagtggggaatattggacaatgggcgaaagcctgatccagcaataccgagtgagtgatgaaggccttagggttgtaaagctcttttagcaaggaagataatgacgttacttgcagaaaaagccccggctaactccgtgccagcagccgcggtaagacggagggggctagcgttgttcggaattactgggcgtaaagagtgcgtaggcggtttagtaagttggaagtgaaagcccggggcttaacctcggaattgctttcaaaactactaatctagagtgtagtaggggatgatggaattcctagtgtagaggtgaaattcttagatattaggaggaacaccggtggcgaaggcggtcatctgggctacaactgacgctgatgcacgaaagcgtggggagcaaacaggattagataccctggtagtccacgccgtaaacgatgagtgctagatatcggaggattctctttcggtttcgcagctaacgcattaagcactccgcctggggagtacggtcgcaagattaaaactcaaaggaattgacgggggctcgcacaagcggtggagcatgcggtttaattcgatgttacgcgaaaaaccttaccaacccttgacatggtggttacggattgcagagatgctttccttcagttcggctgggccacacacaggtgttgcatggctgtcgtcagctcgtgtcgtgagatgttgggttaagtcccgcaacgagcgcaacccttattcttatttgccagtgggtaatgccgggaactataagaaaactgccggtgataagccggaggaaggtggggacgacgtcaagtcatcatggcccttacgggttgggctacacgcgtgctacaatggtgtttacagagggaagcaatacggtgacgtggagcaaatccctaaaagacatctcagttcggattgttctctgcaactcgagagcatgaagttggaatcgctagtaatcgcggatcagcatgccgcggtgaatacgttctcgggccttgtacacactgcccgtcacgccatgggagttggttttacctgaaggtggtgagctaacgcaagaggcagccaaccacggtaaaattagcgactggggtgaagtcgtaacaaggtagccgtaggggaacctgcggctggattacctcctta

SEQ ID NO: 1630 - DNA, 1501 bp, Rickettsia rickettsii
tcaaacttgagagtttgatcctggctcagaacgaacgctatcggtatgcttaacacatgcaagtcgaacggactaattggggcttgctccaattagttagtggcagacgggtgagtaacacgtgggaatctacccatcagtacggaataacttttagaaataaaagctaataccgtatattctctgcggaggaaagatttatcgctgatggatgagcccgcgtcagattaggtagttggtgaggtaatggctcaccaagccgacgatctgtagctggtctgagaggatgatcagccacactgggactgagacacggcccagactcctacgggaggcagcagtggggaatattggacaatgggcgaaagcctgatccagcaataccgagtgagtgatgaaggccttagggttgtaaagctcttttagcaaggaagataatgacgttacttgcagaaaaagccccggctaactccgtgccagcagccgcggtaagacggagggggctagcgttgttcggaattactgggcgtaaagagtgcgtaggcggtttagtaagttggaagtgaaagcccggggcttaacctcggaattgctttcaaaactactaatctagagtgtagtaggggatgatggaattcctagtgtagaggtgaaattcttagatattaggaggaacaccggtggcgaaggcggtcatctgggctaccactgacgctgatgcacgaaagcgtggggagcaaacaggattagataccctggtagtccacgccgtaaacgatgagtgctagatatcggaagattctctttcggtttcgcagctaacgcattaagcactccgcctggggagtacggtcgcaagattaaaactcaaaggaattgacgggggctcgcacaagcggtggagcatgcggtttaattcgatgttacgcgaaaaaccttaccaacccttgacatggtggttgcggatcgcagagatgcttttcttcagctcggctggaccacacacaggtgttgcatggctgtcgtcagctcgtgtcgtgagatgttgggttaagtcccgcaacgagcgcaaccctcattcttatttgccagcgggtaatgccgggaactataagaaaactgccggtgataagccggaggaaggtggggacgacgtcaagtcatcatggcccttacgggttgggctacacgcgtgctacaatggtgtttacagagggaagcaagacggcgacgtggagcaaatccctaaaagacatctcagttcggattgttctctgcaactcgagagcatgaagttggaatcgctagtaatcgcggatcagcatgccgcggtgaatacgttctcgggccttgtacacactgcccgtcacgccatgggagttagttttacctgaaggtggtgagctaacgcaagaggcagccaaccacggtaaaattagcgactggggtgaagtcgtaacaaggtagccgtaggggaacctgcggctggattacctcctta

SEQ ID NO: 1631 - DNA, 1432 bp, Rickettsia slovaca
agaacgaacgctatcggtatgcttaacacatgcaagtcgaacggactaattggggcttgctccaattagttagtggcagacgggtgagtaacacgtgggaatctacccatcagtacggaataacttttagaaataaaagctaataccgtatattctctgcggaggaaagatttatcgctgatggatgagcccgcgtcagattaggtagttggtgaggtaatggctcaccaagccgacgatctgtagctggtctgagaggatgatcagccacactgggactgagacacggcccagactcctacgggaggcagcagtggggaatattggacaatgggcgaaagcctgatccagcaataccgagtgagtgatgaaggccttagggttgtaaagctcttttagcaaggaagataatgacgttacttgcagaaaaagccccggctaactccgtgccagcagccgcggtaagacggagggggctagcgttgttcggaattactgggcgtaaagagtgcgtaggcggtttagtaagttggaagtgaaagcccggggcttaacctcggaattgctttcaaaactactaatctagagtgtagtaggggatgatggaattcctagtgtagaggtgaaattcttagatattaggaggaacaccggtggcgaaggcggtcatctgggctacaactgacgctgatgcacgaaagcgtggggagcaaacaggattagataccctggtagtccacgccgtaaacgatgagtgctagatatcggaagattctctttcggtttcgtagctaacgcattaagcactccgcctggggagtacggtcgcaagattaaaactcaaaggaattgacgggggctcgcacaagcggtggagcatgcggtttaattcgatgttacgcgaaaaaccttaccaacccttgacatggtggtcgcggatcgcagagatgcttttcttcagctcggctggaccacacacaggtgttgcatggctgtcgtcagctcgtgtcgtgagatgttgggttaagtcccgcaacgagcgcaaccctcattcttatttgccagcgggtaatgccgggaactataagaaaactgccggtgataagccggaggaaggtggggacgacgtcaagtcatcatggcccttacgggttgggctacacgcgtgctacaatggtgtttacagagggaagcaagacggcgacgtggagcaaatccctaaaagacatctcagttcggattgttctctgcaactcgagagcatgaagttggaatcgctagtaatcgcggatcagcatgccgcggtgaatacgttctcgggccttgtacacactgcccgtcacgccatgggagttagttttacctgaaggtggtgagctaacgcaagaggcagccaaccacggtaaaattagcgactggggtgaagtcgtaa

SEQ ID NO: 1632 - DNA, 1501 bp, Rickettsia typhi
tcaaacttgagagtttgatcctggctcagaacgaacgctatcggtatgcttaacacatgcaagtcgaacggattaattagagcttgctctagttaattagtggcagacgggtgagtaacacgtgggaatctacccatcagtacggaataacttttagaaataaaagctaataccgtatattctctacggaggaaagatttatcgctgatggatgggcccgcgtcagattaggtagttggtgtggtaatggctcaccaagccgacgatctgtagctggtctgagaggatgatcagccacactgggactgagacacggcccagactcctacgggaggcagcagtggggaatattggacaatgggcgaaagcctgatccagcaataccgagtgagtgatgaaggccttagggttgtaaagctcttttagcaaggaagataatgacgttacttgcagaaaaagccccggctaactccgtgccagcagccgcggtaagacggagggggctagcgttgttcggaattactgggcgtaaagagtgcgtaggtggtttagtaagttggaagtgaaagcccggggcttaacctcggaattgctttcaaaactactaatctagagtgtagtaggggatgatggaattcctagtgtagaggtgaaattcttagatattaggaggaacaccggtggcgaaggcggtcatctgggctacaactgacgctgatgcacgaaagcgtggggagcaaacaggattagataccctggtagtccacgccgtaaacgatgagtgctagatatcggaggattctctttcggtttcgcagctaacgcattaagcactccgcctggggagtacggtcgcaagattaaaactcaaaggaattgacgggggctcgcacaagcggtggagcatgcggtttaattcgatgttacgcgaaaaaccttaccaacccttgacatggtggttatggattgcagagatgctttccttcagttcggctgggccacacacaggtgttgcatggctgtcgtcagctcgtgtcgtgagatgttgggttaagtcccgcaacgagcgcaacccttattcttatttgccagcgggtaatgccgggaactataagaaaactgccggtgataagccggaggaaggtggggacgacgtcaagtcatcatggcccttacgggttgggctacacgcgtgctacaatggtgtttacagagggaagcaagacggtgacgtggagcaaatccctaaaagacatctcagttcggattgttctctgcaactcgagagcatgaagttggaatcgctagtaatcgcggatcagcatgccgcggtgaatacgttctcgggccttgtacacactgcccgtcacgccatgggagttggttttacctgaaggtggtgagctaacgcaagaggcagccaaccacggtaaaattagcgactggggtgaagtcgtaacaaggtagccgtaggggaacctgcggctggattacctcctta

SEQ ID NO: 1633 - DNA, 1526 bp, Robinsoniella peoriensis
gagagtttgattctggctcaggatgaacgctggcggcgtgcttaacacatgcaagtcgagcgaagcattaaaacagatttcttcggaawgaagttttratgactgagcggcggacgggtgagtaacgcgtgggtgaccygcctcatacagggggataacagacagaaatgtctgctaataccgcataagcgcacagtgctgcatggcacagtgtgaaaaactccggtggtatgagatggacccgcgtctgattagctagttggtaaggtaacggcttaccaaggcgacgatcagtagccggcctgagagggtgaacggccacattgggactgagacacggcccaaactcctacgggaggcagcagtggggaatattgcacaatgggggaaaccctgatgcagcgacgccgcgtgaaggaagaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggcatggcaagtctggtgtgaaaggcaggggctcaacccctggactgcattggaaactgtcaggctggagtgcaggagaggtaagtggaattcctagtgtagcggtgaaatgcgtagatattaggaggaacaccagtggcgaaggcgacttactggactgtaactgacgttgaggctcgaaagcgtggggagcaaacaggattagataccctggtagtccacgccgtaaacgatgaatactaggtgtcagggagcaaagctctttggtgccgcagctaacgcaataagtattccacctggggagtacgttcgcaagaatgaaactcaaaggaattgacggggacccgcacaagcggtggagcatgtggtttaattcgaagcaacgcgaagaaccttaccaagtcttgacatcctcttgaccggacagtaacgtgtcctttccttcgggacaagagtgacaggtggtgcatggttgtcgtcagctcgtgtcgtgagatgttgggttaagtcccgcaacgagcgcaacccttatcttcagtagccagcaattcggttgggcactctggagagactgccagggataacctggaggaaggtggggatgacgtcaaatcatcatgccccttatgatttgggctacacacgtgctacaatggcgtaaacaaagggaagcagccctgtgaaggtgagcaaatcccaaaaataacgtctcagttcggattgtagtctgcaactcgactacatgaagctggaatcgctagtaatcgcgaatcagaatgtcgcggatsaatacgttcccgggtcttgtacacaccgcccgtcacaccatgggagtcggaaatgcccgaagtcagtgacccaaccgtaaggagggagctgccgaaggtggagccggtaactggggtgaagtcgtaacaaggtagccgtatcggaaggtgcggctggatcacctccttc

SEQ ID NO: 1634 - DNA, 1371 bp, Roseburia cecicola
ggatgaacgctggcggcgtgcttaacacatgcaagtcgaacgaagcactctatttgattttcttcggaaatgaagattttgtgactgagtggcggacgggtgagtaacgcgtgggtaacctgctcatacagggggataacagttggaaacgactgctaataccgcataagcgcacagtactgcatggtaccgtgtgaaaaactccggtggtatgagatggacccgcgtctgattagccagttggcggggtacggcccaccaaagcgacgatcagtagccgacctgagagggtgaccggccacattgggactgagacacggcccaaactcctacgggaggcagcagtggggaatattgcacaatgggggaaaccctgagcagcgacgccgcgtgagcgaagaagtatttcggtatgtaaagctctatcagcagggaagaaaaaatgacggtacctgactaagaagcaccggctaaatacgtgccagcagccgcggtaatacgtatgtgcaagcgttatccggatttactgggtgtaaagggagcgcaggcggtgcggcaagtctgatgtgaaagcccggggctcaaccccggtactgcattggaaactgtcgtactagagtgtcggaggggtagtggaattcctagtgtagcggtgaaatgcgtagatattaggaggaacaccagtggcgaaggcggcttactggacgattactgacgctgaggctcgaaagcgtggggagcaaacaggattagatacctggtagtccacgccgtaaacgatgaatactaggtgtcggggagcattgctcttcggtgccgcagcaaacgcaataagtattccacctggggagtacgttcgcaagaatgaaactcaaaggaattgacgggacccgcacaagcggtggagcatgtggtttaattcgaagcaacgcgaagaaccttaccaagtcttgacatccttctgacaatgtatgtaatgtatattctcttcggagcagaagtgacaggtggtcatggttgtcgtcagctcgtgtcgtgagatgttgggttaagtcccgcaacgagcgcaacccttattcttagtagccagcggttcgagactgccagggataacctggaggaaggtggggatgacgtcaatcatcatgccccttatgacctacaatggcgtaaacaaagggaagcaagaccgtgaggtggagcaaatcccaaaaataacgtctctgcaactcgactacacgaagctggaatcgctagtaatcgcgatcagaatgtcgcggtgaataacacaccgcccgtcacaccatgggagttggtaatgcccgaagtcagtgacccaaccgcaaggagaggatcgataactggggtgaa

SEQ ID NO: 1635 - DNA, 1361 bp, Roseburia faecalis
tatttgattttcttcggaaatgaagattttgtgactgagtggcggacgggtgagtaacgcgtgggtaacctgcctcatacagggggataacagttggaaacgactgctaataccgcataagcgcacaggatcgcatgatctggtgtgaaaaactccggtggtatgagatggacccgcgtctgattagccagttggcagggtaacggcctaccaaagcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaagaatgacggtacctgactaagaagcaccggctaaatacgtgccagcagccgcggtaatacgtatggtgcaagcgttatccggatttactgggtgtaaagggagcgcaggcggtgcggcaagtctgatgtgaaagcccggggctcaaccccggtactgcattggaaactgtcgtactagagtgtcgaggggtaagtggaattcctagtgtacggtgaaatgcgtagatattaggaggaacaccagtggcgaagcggcttactggacgataactgacgctgaggctcgaaagcgtggggagcaaacaggattagataccctggtagtccacgccgtaaacgatgaatactagtgtcggggagcattgctcttcggtgccgcacaaacgcaataagtattccacctggggagtacgttcgcaagaatgaaactcaaggaattgacggggacccgcacaagcggtggagcatgtgggttaattcgaagcaacgcgaagaaccttaccaagtcttgacatcccgatgacaaagtatgtaatgtactttctcttcggagcatcggtgacaggtggtgcatggttgtcgtcagctcgtgtcgtgagatgttgggttaagtcccgcaacgagcgcaacccctgttcttagtagccagcggttcggccgggcactctagggagactgccagggataacctggaggaaggcggggatgacgtcaaatcatcatgccccttatgacttgggctacacacgtgctacaatggcgtaaacaaagggaagcggagccgtgaggccgagcaaatctcaaaaataacgtctcagttcggactgtagtctgcaacccgactacacgaagctggaatcgctagtaatcgcagatcagaatgctgcggtgaatacgttcccgggtcttgtacacaccgcccgtcacaccatgggagttggaaatgcccgaagtcagtgacccaaccgc

SEQ ID NO: 1636 - DNA, 1297 bp, Roseburia faecis
gatgaacgctggcggcgtgcttaacacatgcaagtcgaacgagtggcggacgggtgagtaacgcgtgggtaacctgcctcatacagggggataacagttggaaacgactgctaataccgcataagaaaaagtggtatgagatggacccgcgtctgattagccagttggcagggtaacggcctaccaaagcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagatgacggtacctgactaagaagcaccggctaaatacgtgccagcagccgcggtaatacgtatggtgcaagcgttatccggatttactgggtgtaaagggagcgcaggcggtgcggcaagtctgatgtgaaagcccggggctcaaccccggtactgcattggaaactgtcgtactagagtgtcggaggggtaagtggaattcctagtgtagcggtgaaatgcgtagatattaggaggaacaccagtggcgaaggcggcttactggacgaactgacgctgaggctcgaaagcgtggggagcaaacaggattagataccctggtagtccacgccgtaaacgatgaatactaggtgtcggggcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcgacaggtggtgcatggttgtcgtcagctcgtgtcgtgagatgttgggttaagtcccgcaacgagcgcaacccctgtccttagtagccagcggccgggcactctagggagactgccagggataacctggaggaaggcggggatgacgtcaaatcatcatgccccttatgacttgggctacacacgtgctacaatggcgtacaaagggaagcggagccgtgaggccgagcaaatctcaaaacgtctcagttcggatgtagtctgcaacccgactacagaagctggaatcgctagtaatcgcagatcagaatgctgcggtgaatacgttcccgggtcttgtacacaccgcccgtcacaccatgggagttggaaatgcccgaagtcagtacccagggagctgccgaaggcaggttcgataactggggtg

SEQ ID NO: 1637 - DNA, 1376 bp, Roseburia hominis
  modified_base (14)..(14): a, c, t, g, unknown or other
  modified_base (14)..(14): a, c, t, g, unknown or other
  modified_base (45)..(47): a, c, t, g, unknown or other
  modified_base (45)..(47): a, c, t, g, unknown or other
acgaagcactttanttgatttcttcggaatgaagtttttgtgacnnnagtggcggacgggtgagtaacgcgtgggtaacctgcctcatacagggggataacagttggaaacgactgctaataccgcataagcgcacaggattgcatgatccagtgtgaaaaactccggtggtatgagatggacccgcgtctgattagccagttggcggggtaacggcccaccaaagcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaagaatgacggtacctgactaagaagcaccggctaaatacgtgccagcagccgcggtaatacgtatggtgcaagcgttatccggatttactgggtgtaaagggagcgcaggcggtacggcaagtctgatgtgaaatcccggggctcaaccccggtactgcattggaaactgtcggactagagtgtcggaggggtaagtggaattcctagtgtagcggtgaaatgcgtagatattaggaggaacaccagtggcgaaggcggcttactggacgattactgacgctgaggctcgaaagcgtggggagcaaacaggattagataccctggtagtccacgccgtaaacgatgaatactaggtgtcggggagcattgctcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccactgacagagtatgtaatgtactttctcttcggaacagtggtgacagatggtgcatgggggtcgtcagctcgtgtcgtgagatgttgggttaagtcccgcaacgagcgcaacccctattcttagtagccagcggtttggccgggcactctagggagactgccagggataacctggaggaaggtggggatgacgtcaaatcatcatgccccttatgacttgggctacacacgtgctacaatggcgtaaacaaagggaagcaatcccgcgagggggagcaaatctcaaaaataacgtctcagttcggactgtagtctgcaactcgactacacgaagctggaatcgctagtaatcgcgaatcagaatgtcgcggtgaatacgttcccgggtcttgtacacaccgcccgtcacaccatgggagttggtaatgcccgaagtcagtgacccaaccg

SEQ ID NO: 1638 - DNA, 1390 bp, Roseburia intestinalis
tcgaacgaagcactttatttgatttcttcggaatgaagattttgtgactgagtggcggacgggtgagtaacgcgtgggtaacctgcctcatacagggggataacagttggaaacgactgctaataccgcataagcgcacagggtcgcatgacctggtgtgaaaaactccggtggtatgagatggacccgcgtctgattagccagttggtggggtaacggcctaccaaagcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaagaaatgacggtacctgactaagaagcaccggcaaatactgccagcagccgcggtaatacgtatggtgcaagcgttatccggatttactgggtgtaaagggagcgcaggcggtacggcaagtctgatgtgaaagcccggggctcaaccccggtactgcattggaaactgtcggactagagtgtcggaggggtaagtggaattcctagtgtagcggtgaaatgcgtagatattaggaggaacaccagtggcgaaggcggcttactggacgattactgacgctgagctcgaaagcgtggggagcaaacaggattagataccctggtagtccacgccgtaaacgatgaatactaggtgtcggggagcattgctcttcggtgccgcagcaaacgcaataagtattccacctggggagtacgttcgcaagaatgaaactcaaaggaattgacggggacccgcacaagcggtggaccatgtggtttaattcgaagcaacgcgaagaaccttaccaagtcttgacatcccgatgacagaacatgtaatgtgttttctcttcgaagcatcggtgacagagggtcggaggggtaagtgagctcgtgtcgtgagatgttgggttaagtcccgcaacgagcgcaacccctattcttagtagccagcggttaagccgggcactctagggagactgccagggataacctggaggaaggtggggatgacgtcaaatcatcatgccccttatgacttgggctacacacgtgctacaatggcgtaaacaaagggaagcgagcctgcgagggggagcaaatctcaaaaataacgtctcagttcggactgcagtctgcaactcgactgcacgaagctggaatcgctagtaatcgcgaatcagaatgtcgcggtgaatacgttcccgggtcttgtacacaccgcccgtcacaccatgggagttggtaatgcccgaagtcagtgacccaaccgcaaggagggagct

SEQ ID NO: 1639 - DNA, 1374 bp, Roseburia inulinivorans
  modified_base (19)..(19): a, c, t, g, unknown or other
  modified_base (19)..(19): a, c, t, g, unknown or other
  modified_base (51)..(51): a, c, t, g, unknown or other
  modified_base (51)..(51): a, c, t, g, unknown or other
  modified_base (951)..(951): a, c, t, g, unknown or other
  modified_base (951)..(951): a, c, t, g, unknown or other
gaacgaagcacttttacangatttcttcggaatgaagttttagtgactgantggcggacgggtgagtaacgcgtgggtaacctgcctcacacagggggataacagttggaaacggctgctaataccgcataagcgcacagtaccgcatggtacagtgtgaaaaactccggtggtgtgagatggacccgcgtctgattagctagttggcagggcaacggcctaccaaggcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaaaagaaatgacggtacctgctaaacaccggctaaatacgtgccagcagccgcggtaatacgtatggtgcaagcgttatccggatttactgggtgtaaagggagcgcaggcggaaggctaagtctgatgtgaaagcccggggctcaaccccggtactgcattggaaactggtcatctagagtgtcggaggggtaagtggaattcctagtgtagcggtgaaatgcgtagatattaggaggaacaccagtggcgaaggcggcttactggacgataactgacgctgaggctcgaaagcgtggggagcaaacaggattagataccctggtagtccacgccgtaaacgatgaatactaggtgtcggaaagcacagcttttcggtgccgccgcaaacgcattaagtattccacctggggagtacgttcgcaagaatgaaactcaaaggaattgacggggacccgcacaagcggtggagcatgtggtttaattggtataaagggagagcagcctgacgactaattctgatcttaaagcccggggctaatctgtggtttncttcgggacagaagtgacaggtggtgcatggttgtcgtcagctcgtgtcgtgagatgttgggttaagtcccgcaacgagcgcaacccttatccccagtagccagcggttcggccgggcactctgaggagactgccagggataacctggaggaaggtggggatgacgtcaaatcatcatgccccttatgacttgggctacacacgtgctacaatggcgtaaacaaagggaagcgagaccgtgaggtggagcaaatcccaaaaataacgtctcagttcggactgtagtctgcaacccgactacacgaagctggaatcgctagtaatcgcagatcagaatgctgcggtgaatacgttcccgggtcttgtacacaccgcccgtcacaccatgggagttggaaatgcccgaagtcagtgacccaaccg

SEQ ID NO: 1640 - DNA, 1235 bp, Roseburia sp.
  11SE37
tggcggcgtgcttaacacatgcaagtcgaacgagtggcggacgggtgagtaacgcgtgggtaacctgcctcatacagggggataacagttggaaacgactgctaataccgcataagaaaaagtggtatgagatggacccgcgtctgattagccagttggcagggtaacggcctaccaaagcgacgatcagtagccaacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagatgacggtacctgactaagaagcaccggctaaatacgtgccagcagccgcggtaatacgtatggtgcaagcgttatccggatttactgggtgtaaagggagcgcaggcggtgcggcaagtctgatgtgaaagcccggggctcaaccccggtactgcattggaaactgtcgtactagagtgtcggaggggtaagtggaattcctagtgtagcggtgaaatgcgtagatattaggaggaacaccagtggcgaaggcggcttactggacgaactgacgctgaggctcgaaagcgtggggagcaaacaggattagataccctggtagtccacgccgtaaacgatgaatactaggtgtcggggcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcgacaggtggtgcatggttgtcgtcagctcgtgtcgtgagatgttgggttaagtcccgcaacgagcgcaacccctgttcttagtagccagcggccgggcactctagggagactgccagggataacctggaggaaggcggggatgacgtcaaatcatcatgccccttatgacttgggctacacacgtgctacaatggcgtacaaagggaagcaaagccgtgaggccgagcaaatctcaaaacgtctcagttcggatgtagtctgcaacccgactacagaagctggaatcgctagtaatcgcagatcagaatgctgcggtgaatacgttcccgggtcttgtacacaccgcccgtcacaccatgggagttggaaat

SEQ ID NO: 1641 - DNA, 1231 bp, Roseburia sp.
  11SE38
tggcggcgtgcttaacacatgcaagtcgaacgagtggcggacgggtgagtaacgcgtgggtaacctgcctcatacagggggataacagttggaaacgactgctaataccgcataagaaaaagtggtatgagatggacccgcgtctgattagccagttggcagggtaacggcctaccaaagcgacgatcagtagccaacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagatgacggtacctgactaagaagcaccggctaaatacgtgccagcagccgcggtaatacgtatggtgcaagcgttatccggatttactgggtgtaaagggagcgcaggcggtgcggcaagtctgatgtgaaagcccggggctcaaccccggtactgcattggaaactgtcgtactagagtgtcggaggggtaagtggaattcctagtgtagcggtgaaatgcgtagatattaggaggaacaccagtggcgaaggcggcttactggacgaactgacgctgaggctcgaaagcgtggggagcaaacaggattagataccctggtagtccacgccgtaaacgatgaatactaggtgtcggggcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcgacaggtggtgcatggttgtcgtcagctcgtgtcgtgagatgttgggttaagtcccgcaacgagcgcaacccctgttcttagtagccagcggccgggcactctagggagactgccagggataacctggaggaaggcggggatgacgtcaaatcatcatgccccttatgacttgggctacacacgtgctacaatggcgtacaaagggaagcaaagccgtgaggccgagcaaatctcaaaacgtctcagttcggatgtagtctgcaacccgactacagaagctggaatcgctagtaatcgcagatcagaatgctgcggtgaatacgttcccgggtcttgtacacaccgcccgtcacaccatgggagttgg

SEQ ID NO: 1642 - DNA, 1469 bp, Roseiflexus castenholzii
agagtttgatcctggctcaggacgaacgctggcggcgtgcctaatgcatgcaagtcgaacgcacgcgcttcggcgcgtgagtggcgcacggctgagtaacacgtgggaacccgccctccggtgggggataacgagacgaaagtcgcgctaatcccgcatacgtccgcaaggggaaagcgcttcggcgcgccggaggaggggcctgcggcccatcaggtggttggtggggtaacggcctaccaagccgatgacgggtagctggtctgggaggatgaccagccagactgggactgagacacggcccagactcctacgggaggcagcagcaaggaattttcggcaatgggcgcaagcctgaccgagcaacgccgcgtgcgggatgacggccttcgggttgtaaaccgcttttcggggggacgactacgacggtacccccggaagaagccccggctaactctgtgccagcagccgcggtaagacagagggggcgagcgttgtccggagttactgggcgtaaagcgcgcgcaggcggtggtctcagtgtcgtgtgaaagcccccggctcaaccgggggaggtcatggcaaactagacgactagagcggcggagaggcccctcgaattgccggtgtagcggtgaaatgcgtagagatcggcaggaagaccaagggggaagccagggggctggccgctggctgacgctgaggcgcgacagcgtggggagcaaaccggattagatacccgggtagtccacgccgtaaacgatgaccactcggcgtgtggcgactattgacgtcgcggcgcgcctaagcttacgcgtgaagtggtccgcctgggaactacgagcgcaagcttaaaactcaaaggaattgacgggggcccgcacaagcagcggagcgtgtggtttaattcgaggcaacccgaagaaccttacccaggctggacatgacggtgcaggcggcggaaacgtcgcggccttcgagggaccgtcacaggtgctgcatggctgtcgtcagctcgtgtcgtgagatgttgggttaagtcccgcaacgagcgcaacccctgcggttagttaccggtgtctaaccggactgcccttcggggaggaaggcggggatgacgtcaagtccgcatggccctgacgcctggggcgacacacacgctacaatggcgccgacaatgcgtggcgaccgcgcgagcggaggcaaatcgccaaacggcgtctcagtgcagatcgggggctgcaactcgcccccgtgaaggcggagttgctagtaaccgcgtatcagccatggcgcggtgaatacgtacccgggccttgtacacaccgcccgtcacgtcatgggagttgtcaatgcctgaagtccgtgcgctaaccgtcaggaggcagcggccgagggcaggggcagcgactgggacgaagtcgtaacaaggtagccgtaccggaaggtgcggctggatcacctccttt

SEQ ID NO: 1643 - DNA, 1312 bp, Roseomonas cervicalis
aagcagcgatgcgcctttggagtaacctgcgtccgattagctagttggtggggtaaaggcctaccaaggcgacgatcggtagctggtctgagaggacgaccagccacactgggactgagacacggcccagactcctacgggaggcagcagtggggaatattggacaatgggcgcaagcctgatccagcaatgccgcgtgggtgaagaaggtcttcggatcgtaaagccctttcggcggggacgatgatgacggtacccgcagaagaagccccggctaacttcgtgccagcagccgcggtaatacgaagggggctagcgttactcggaattactgggcgtaaagggcgcgtaggcggcgctccaagttaggcgtgaaagccctgggctcaacctggggactgcgcttaagactggagtgctagaggatggaagagggttgtggaattcccagtgtagaggtgaaattcgtagatattgggaagaacaccggtggcgaaggcggcaacctggtccatttctgacgctgaggcgcgatagcgtggggagcaaacaggattagataccctggtagtccacgccgtaaacgatgtgcgctgaatgttggggttcctagaacctcagtgttgtagctaacgcggtaagcgcaccgcctggggagtacggccgcaaggttgaaactcaaaggaattgacgggggcccgcacaagcggtggagcatgtggtttaattcgaagcaacgcgcagaaccttaccagcccttgacatggccacgaccggttcagagatgaacttttcccgcaagggacgtggtgcacaggtgctgcatggctgtcgtcagctcgtgtcgtgagatgttgggttaagtcccgcaacgagcgcaaccctcgcctttagttgccagcacgtttgggtgggcactctagaggaactgccggtgacaagccggaggaaggtggggatgacgtcaagtcctcatggcccttatgggctgggctacacacgtgctacaatggcggtgacaatgggaagccaggcagcgatgtcgagccgatcccaaaaagccgtctcagttcagatcgcagcctgcaactcggctgcgtgaaggtggaatcgctagtaatcgcggatcagcacgccgcggtgaatacgttcccgggccttgtacacaccgcccgtcacaccatgggagttggttctaccttaagcaggtgcggtaaccgcaaggagctagcctgccacggtagggtcagtgactggggtgaagtcgtaacaaggtagccgtaggggaacctgcggctggatcacctccttt

SEQ ID NO: 1644 - DNA, 1482 bp, Roseomonas mucosa
ttagtttgatcctggctcagagcgaacgctggcggcatgcttaacacatgcaagtcgcacgggcagcaatgtcagtggcggacgggtgagtaacgcgtaggaacgtgtcctgaggtgggggacaaccccgggaaactggggctaataccgcatatgggctgaggcccaaagccgagaggcgcctttggagcggcctgcgtccgattaggtagttggtggggtaaaggcctaccaagcctgcgatcggtagctggtctgagaggacgaccagccacactgggactgagacacggcccagactcctacgggaggcagcagtggggaatattggacaatgggcgaaagcctgatccagcaatgccgcgtgggtgaagaaggtcttcggatcgtaaagccctttcgacggggacgatgatgacggtacccgtagaagaagccccggctaacttcgtgccagcagccgcggtaatacgaagggggctagcgttgctcggaattactgggcgtaaagggcgcgtaggcggcggcccaagtcaggcgtgaaattcctgggctcaacctggggactgcgcttgatactgggttgcttgaggatggaagaggctcgtggaattcccagtgtagaggtgaaattcgtagatattgggaagaacaccggtggcgaaggcggcgagctggtccattactgacgctgaggcgcgacagcgtggggagcaaacaggattagataccctggtagtccacgccgtaaacgatgtgcgctggatgttggggcccatagggtctcagtgtcgtagccaacgcggtaagcgcaccgcctggggagtacggccgcaaggttgaaactcaaaggaattgacgggggcccgcacaagcggtggagcatgtggtttaattcgaagcaacgcgcagaaccttaccagcccttgacatggtcacgaccggtccagagatggactttcctagcaataggcgtgatgcacaggtgctgcatggctgtcgtcagctcgtgtcgtgagatgttgggttaagtcccgcaacgagcgcaaccctcgcctctagttgccagcatgttcgggtgggcactctagaggaactgccggtgacaagccggaggaaggtggggatgacgtcaagtcctcatggcccttatgggctgggctacacacgtgctacaatggcggtgacagagggaagccaggtcgcgaggccgagccgatcccgaaaagccgtctcagttcggattgcactctgcaactcgggtgcatgaaggtggaatcgctagtaatcgcggatcagcacgccgcggtgaatacgttcccgggccttgtacacaccgcccgtcacaccatgggagttggttctaccttaagtcgttgcgctaaccagcgatgggggcaggcgaccacggtagggtcagcgactggggtgaagtcgtaacaaggtagccgtaggggaacctgcggttggatcacctcctaa

SEQ ID NO: 1645 - DNA, 1295 bp, Roseomonas sp.
  NML94-0193
acgctggcggcatgcttaacacatgcaagtcgcacgagtggcggacgggtgagtaacgcgtaggaacgtgtccagaggtgggggacaaccccgggaaactggggctaataccgcatgggcaaaggcgccattggagcggcctgcgtccgattaggtagttggtggggtaaaggcctaccaagcctgcgatcggtagctggtctgagaggacgaccagccacactgggactgagacacggcccagactcctacgggaggcagcagtggggaatattggacaatgggcgaaagcctgatccagcaatgccgcgtgggtgaagaaggtcttcggatcgtaaagccctttcgacggggacgatgacggtacccgtagaagaagccccggctaacttcgtgccagcagccgcggtaatacgaagggggctagcgttgctcggaattactgggcgtaaagggcgcgtaggcggcggcccaagtcaggcgtgaaattcctgggctcaacctggggactgcgcttgatactgggttgcttgaggatggaagaggctcgtggaattcccagtgtagaggtgaaattcgtagatattgggaagaacaccggtggcgaaggcggcgagctggtccaactgacgctgaggcgcgacagcgtggggagcaaacaggattagataccctggtagtccacgccgtaaacgatgtgcgctggatgttggggtctcagtgtcgtagccaacgcggtaagcgcaccgcctggggagtacggccgcaaggttgaaactcaaaggaattgacgggggcccgcacaagcggtggagcatgtggtttaattcgaagcaacgcgcagaaccttaccagcccttgacatgcacaggtgctgcatggctgtcgtcagctcgtgtcgtgagatgttgggttaagtcccgcaacgagcgcaaccctcgcctctagttgccagcatgtgggcactctagaggaactgccggtgacaagccggaggaaggtggggatgacgtcaagtcctcatggcccttatgggctgggctacacacgtgctacaatggcggtcagagggaagccaggtcgcgaggccgagccgatcccggccgtctcagttcggatgcactctgcaactcgggtgcagaaggtggaatcgctagtaatcgcggatcagcacgccgcggtgaatacgttcccgggccttgtacacaccgcccgtcacaccatgggagttggttctaccttaagtcgttcgctaggcaggcgaccacggtagggtcagcgactggggtgaagtc

SEQ ID NO: 1646 - DNA, 1319 bp, Roseomonas sp.
  NML97-0121
agcgaacgctggcggcatgcttaacacatgcaagtcgcacgagtggcggacgggtgagtaacgcgtaggaacgtgtccagaggtgggggacaaccccgggaaactggggctaataccgcatatgcaaaggcgcctttggagcggcctgcgtccgattaggtagttggtggggtaaaggcctaccaagcctgcgatcggtagctggtctgagaggacgaccagccacactgggactgagacacggcccagactcctacgggaggcagcagtggggaatattggacaatgggcgaaagcctgatccagcaatgccgcgtgggtgaagaaggtcttcggatcgtaaagccctttcgacggggacgatgacggtacccgtagaagaagccccggctaacttcgtgccagcagccgcggtaatacgaagggggctagcgttgctcggaattactgggcgtaaagggcgcgtaggcggcggcccaagtcaggcgtgaaattcctgggctcaacctggggactgcgcttgatactgggttgcttgaggatggaagaggctcgtggaattcccagtgtagaggtgaaattcgtagatattgggaagaacaccggtggcgaaggcggcgagctggtccaactgacgctgaggcgcgacagcgtggggagcaaacaggattagataccctggtagtccacgccgtaaacgatgtgcgctggatgttggggtctcagtgtcgtagccaacgcggtaagcgcaccgcctggggagtacggccgcaaggttgaaactcaaaggaattgacgggggcccgcacaagcggtggagcatgtggtttaattcgaagcaacgcgcagaaccttaccagcccttgacatgcacaggtgctgcatggctgtcgtcagctcgtgtcgtgagatgttgggttaagtcccgcaacgagcgcaaccctcgcctctagttgccagcatgtgggcactctagaggaactgccggtgacaagccggaggaaggtggggatgacgtcaagtcctcatggcccttatgggctgggctacacacgtgctacaatggcggtcagagggaagccaggtcgcgaggccgagccgatcccggccgtctcagttcggatgcactctgcaactcgggtgcagaaggtggaatcgctagtaatcgcggatcagcacgccgcggtgaatacgttcccgggccttgtacacaccgcccgtcacaccatgggagttggttctaccttaagtcgttcgctaggcaggcgaccacggtagggtcagcgactggggtgaagtcgtaacaaggtagccgtagg

SEQ ID NO: 1647 - DNA, 1314 bp, Roseomonas sp.
  NML98-0009
acgctggcggcatgcttaacacatgcaagtcgcacgagtggcggacgggtgagtaacgcgtaggaacgtgtccagaggtgggggacaaccccgggaaactggggctaataccgcatatgcaaaggcgcctttggagcggcctgcgtccgattaggtagttggtggggtaaaggcctaccaagcctgcgatcggtagctggtctgagaggacgaccagccacactgggactgagacacggcccagactcctacgggaggcagcagtggggaatattggacaatgggcgaaagcctgatccagcaatgccgcgtgggtgaagaaggtcttcggatcgtaaagccctttcgacggggacgatgacggtacccgtagaagaagccccggctaacttcgtgccagcagccgcggtaatacgaagggggctagcgttgctcggaattactgggcgtaaagggcgcgtaggcggcggcccaagtcaggcgtgaaattcctgggctcaacctggggactgcgcttgatactgggttgcttgaggatggaagaggctcgtggaattcccagtgtagaggtgaaattcgtagatattgggaagaacaccggtggcgaaggcggcgagctggtccaactgacgctgaggcgcgacagcgtggggagcaaacaggattagataccctggtagtccacgccgtaaacgatgtgcgctggatgttggggtctcagtgtcgtagccaacgcggtaagcgcaccgcctggggagtacggccgcaaggttgaaactcaaaggaattgacgggggcccgcacaagcggtggagcatgtggtttaattcgaagcaacgcgcagaaccttaccagcccttgacatgcacaggtgctgcatggctgtcgtcagctcgtgtcgtgagatgttgggttaagtcccgcaacgagcgcaaccctcgcctctagttgccagcatgtgggcactctagaggaactgccggtgacaagccggaggaaggtggggatgacgtcaagtcctcatggcccttatgggctgggctacacacgtgctacaatggcggtcagagggaagccaggtcgcgaggccgagccgatcccggccgtctcagttcggatgcactctgcaactcgggtgcagaaggtggaatcgctagtaatcgcggatcagcacgccgcggtgaatacgttcccgggccttgtacacaccgcccgtcacaccatgggagttggttctaccttaagtcgttcgctaggcaggcgaccacggtagggtcagcgactggggtgaagtcgtaacaaggtagccgtagg

SEQ ID NO: 1648 - DNA, 1297 bp, Roseomonas sp.
  NML98-0157
agcgaacgctggcggcatgcttaacacatgcaagtcgcacgagtggcggacgggtgagtaacgcgtaggaacgtgtcctgaggtgggggacaaccccgggaaactggggctaataccgcatatgcaaaggcgcctttggagcggcctgcgtccgattaggtagttggtggggtaaaggcctaccaagcctgcgatcggtagctggtctgagaggacgaccagccacactgggactgagacacggcccagactcctacgggaggcagcagtggggaatattggacaatgggcgaaagcctgatccagcaatgccgcgtgggtgaagaaggtcttcggatcgtaaagccctttcgacggggacgatgacggtacccgtagaagaagccccggctaacttcgtgccagcagccgcggtaatacgaagggggctagcgttgctcggaattactgggcgtaaagggcgcgtaggcggcggcccaagtcaggcgtgaaattcctgggctcaacctggggactgcgcttgatactgggttgcttgaggatggaagaggctcgtggaattcccagtgtagaggtgaaattsgtagatattgggaagaacaccggtggygaaggcggcgagctggtccaactgacgctgaggcgcgacagcgtggggagcaaacaggattagataccctggtagtccacgccgtaaacgatgtgcgctggatgttggggtctcagtgtcgtagccaacgcggtaagcgcaccgcctggggagtacggccgcaaggttgaaactcaaaggaattgacgggggcccgcacaagcggtggagcatgtggtttaattcgaagcaacgcgcagaaccttaccagcccttgacatgcacaggtgctgcatggctgtcgtcagctcgtgtcgtgagatgttgggttaagtcccgcaacgagcgcaaccctcgcctctagttgccagcatgtgggcactctagaggaactgccggtgacaagccggaggaaggtggggatgacgtcaagtcctcatggcccttatgggctgggctacacacgtgctacdatggcggtcagagggaagccaggtcgcgaggccgagccgatcccggccgtctcagttcggatgcactctgcaactcgggtgcagaaggtggaatcgctagtaatcgcggatcagcacgccgcggtgaatacgttcccgggccttgtacacaccgcccgtcacaccatgggagttggttctaccttaagtcgttcgctaggcaggcgaccacggtagggtcagcgactggggtgaa

SEQ ID NO: 1649 - DNA, 1269 bp, Rothia aeria
  modified_base (838)..(838): a, c, t, g, unknown or other
  modified_base (838)..(838): a, c, t, g, unknown or other
  modified_base (1115)..(1115): a, c, t, g, unknown or other
  modified_base (1115)..(1115): a, c, t, g, unknown or other
  modified_base (1200)..(1200): a, c, t, g, unknown or other
  modified_base (1200)..(1200): a, c, t, g, unknown or other
ccgtggattagtggcgaacgggtgagtaatacgtgagtgacctacctttgactctgggataagcctgggaaactgggtctaataccggatacgaccaatctctgcatggggtgttggtggaaagcgttatggagtggttttagatgggctcacggcctatcagcttgttggtgaggtaatggcttaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctgttagcatcgaagaagcgaaagtgacggtaggtgcagagaaagcgccggctaactacgtgccagcagccgcggtaatacgtagggcgcgagcgttgtccggaattattgggcgtaaagagcttgtaggcggttggtcgcgtctgctgtgaaaggccggggcttaactccggttttgcagtgggtacgggctaactagagtgcagtaggggagactggaattcctggtgtagcggtggaatgcacagatatcaggaggaacaccgatggcgaaggcaggtctctgggctgtaactgacgctgagaagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcactatnggcggagcatgcggattaattcgatgcaacgcgaagaaccttaccaaggcttgacatgcattagatcgcgtcagagatggcgtttcccttcggggctggtgtacaggtggtgcatggttgtcgtcagctcgtgtcgtgagatgttgggttaagtcccgcaacgagcgcaaccctcgttctatgttgccagcggttcggccggggactcataggagactgccggggttaactcggaggaaggtggggatgacgtcaaatcatcatgccccttatgttntgggcttcacgcatgctacaatggccggtacagagggttgcgatactgtgaggtggagctaatcccttaaagccggtctcagttnggattggggtatgcaactcgaccccatgaagtcggagtcgctagtaatcgcagatcagcaacgctgcgg

SEQ ID NO: 1650 - DNA, 1531 bp, Rothia dentocariosa
ttgtaacggagagtttgattctggctcaggacgaacgctggcggcgtgcttaacacatgcaagtcgaacgatgaagcctagcttgctaggtggattagtggcgaacgggtgagtaatacgtgagtgacctacctttgactctgggataagcctgggaaactgggtctaataccggatacgaccaatctccgcatggggtgttggtggaaagcgttatggagtggttttagatgggctcacggcctatcagcttgttggtgaggtaatggcttaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctgttagcatcgaagaagcgaaagtgacggtaggtgcagagaaagcgccggctaactacgtgccagcagccgcggtaatacgtagggcgcgagcgttgtccggaattattgggcgtaaagagcttgtaggcggttggtcgcgtctgctgtgaaaggctggggcttaaccctggttttgcagtgggtacgggctaactagagtgcagtaggggagactggaattcctggtgtagcggtggaatgcgcagatatcaggaggaacaccgatggcgaaggcaggtctctgggctgtaactgacgctgagaagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaagaaattgacgggggcccgcacaagcggcggagcatgcggattaattcgatgcaacgcgaagaaccttaccaaggcttgacatatactggactgcgtcagagatggcgtttcccttcggggctggtatacaggtggtgcatggttgtcgtcagctcgtgtcgtgagatgttgggttaagtcccgcaacgagcgcaaccctcgttctatgttgccagcacgtgatggtggggactcataggagactgccggggtcaactcggaggaaggtggggatgacgtcaaatcatcatgccccttatgtcttgggcttcacgcatgctacaatggccggtacagagggttgcgatactgtgaggtggagctaatccctaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaaccctggtggggggagccgtcgaaggtgggactggcgattgggactaagtcgtaacaaggtagccgtaccggaaggtgcggctggatcacctcctttct

SEQ ID NO: 1651 - DNA, 1535 bp, Rothia mucilaginosa
tttcaacggagagtttgattctggctcaggacgaacgctggcggcgtgcttaacacatgcaagtcgaacgatgaagcctagcttgctaggtggattagtggcgaacgggtgagtaatacgtgagtaacctacctttaactctgggataagcctgggaaactgggtctaataccggatacgaccaatctccgcatggggtgttggtggaaagcgttatgtagtggttatagatgggctcacggcctatcagcttgttggtgaggtaacggctcaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctgttagcagggaagaagagaaattgacggtacctgcagagaaagcgccggctaactacgtgccagcagccgcggtaatacgtagggcgcgagcgttgtccggaattattgggcgtaaagagcttgtaggcggtttgtcgcgtctgctgtgaaaggccggagcttaactccgtgtattgcagtgggtacgggcagactagagtgcagtaggggagactggaactcctggtgtagcggtggaatgcgcagatatcaggaagaacaccgatggcgaaggcaggtctctgggctgtaactgacgctgagaagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaagaaattgacgggggcccgcacaagcggcggagcatgcggattaattcgatgcaacgcgaagaaccttaccaaggcttgacatatactggaccgcatcagagatggtgtttcccttcggggctggtatacaggtggtgcatggttgtcgtcagctcgtgtcgtgagatgttgggttaagtcccgcaacgagcgcaaccctcgttctatgttgccagcacgtaatggtggggactcataggagactgccggggtcaactcggaggaaggtggggatgacgtcaaatcatcatgccccttatgtcttgggcttcacgcatgctacaatggccggtacagagggttgcgatactgtgaggtggagctaatccctaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccaaagccggtggcctaaccttttggagggagccgtctaaggtgggattggcgattgggactaagtcgtaacaaggtagccgtaccggaaggtgcggctggatcacctcctttctaagg

SEQ ID NO: 1652 - DNA, 1481 bp, Rothia nasimurium
gacgaacgctggcggcgtgcttaacacatgcaagtcgaacgatgaagcccagcttgctgggtggattagtggcgaacgggtgagtaatacgtgagtaacctgcctttaactctgggataagccttggaaacgaggtctaataccggatacgaccagttcccgcatgggatgctggtggaaagggatatgtactggttttagatgggctcacggcctatcagcttgttggtgaggtaacggctcaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcgagcgttgtccggaattattgggcgtaaagagcttgtaggcggtttgtcgcgtctgctgtgaaagcccggggcttaaccccgggtttgcagtgggtacgggctaactagagtgcagtaggggagactggaattcctggtgtagcggtgaaatgcgcagatatcaggaggaacaccaatggcgaaggcaggtctctgggctgtaactgacgctgagaagcgaaagcatggggagcaaacaggattagataccctggtagtccatgccgtaaacgttgggcactaggtgtgggggacattccacgttttccgcgccgtagctaacgcattaagtgccccgcctggggagtacggccgcaaggctaaaactcaaagaaattgacgggggcccgcacaagcggcggagcatgcggattaattcgatgcaacgcgaagaaccttaccaaggcttgacatatactggaccgctctagagatagagtttcccttcggggctggtatacaggtggtgcatggttgtcgtcagctcgtgtcgtgagatgttgggttaagtcccgcaacgagcgcaaccctcgttctatgttgccagcacgtaatggtggggactcataggagactgccggggtcaactcggaggaaggtggggatgacgtcaaatcatcatgccccttatgtcttgggcttcacgcatgctacaatggccggtacaaagggttgcgatactgtgaggttgagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccgatggcctaaccccttgtgggagggagtcgtcgaaggtgggattggcgattgggactaagtcgtaacaaggtagccgtaccggaagg

SEQ ID NO: 1653 - DNA, 1500 bp, Rothia sp.
  oral taxon 188
gagtttgatcctggctcaggacgaacgctggcggcgtgcttaacacatgcaagtcgaacgatgaagcggtgcttgcaccgtggattagtggcgaacgggtgagtaatacgtgagtgacctacctttgactctgggataagcctgggaaactgggtctaataccggatacgaccaatctctgcatggggtgttggtggaaagcgttatggagtggttttagatgggctcacggcctatcagcttgttggtgaggtaatggcttaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctgttagcatcgaagaagcgaaagtgacggtaggtgcagagaaagcgccggctaactacgtgccagcagccgcggtaatacgtagggcgcgagcgttgtccggaattattgggcgtaaagagcttgtaggcggttggtcgcgtctgctgtgaaaggccggggcttaactccggttttgcagtgggtacgggctaactagagtgcagtaggggagactggaattcctggtgtagcggtggaatgcacagatatcaggaggaacaccgatggcgaaggcaggtctctgggctgtaactgacgctgagaagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgcattagatcgcgtcagagatggcgtttcccttcggggctggtgtacaggtggtgcatggttgtcgtcagctcgtgtcgtgagatgttgggttaagtcccgcaacgagcgcaaccctcgttctatgttgccagcggttcggccggggactcataggagactgccggggttaactcggaggaaggtggggatgacgtcaaatcatcatgccccttatgtcttgggcttcacgcatgctacaatggccggtacagagggttgcgatactgtgaggtggagctaatcccttaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaacccttgtggggggagccgtcgaaggtgggattggcgattgggactaagtcgtaacaaggtagccgtaccggaaggtgc

SEQ ID NO: 1654 - DNA, 1539 bp, Ruminobacter amylophilus
aaagtgaagagtttgatcatggctcagattgaacgctggcggcaggcttaatacatgcaagtcgaacggtaacagcaggaagcttgcttcctggctgacgagtggcggacgggtgagtaatacctggggagctgcctgaatgagggggacaacacctggaaacgggtgctaataccgcgtaagcctgagggggaaaggctgggcaaccagtcgcattcagatgcgcccaggtgggattagctagttggtggggtaacggcctaccaaggcgacgatctctagctggtctgagaggatgatcagccacactggaactgagacacggtccagactcctacgggaggcagcagtagggaatattgcacaatgggggaaaccctgatgcagccatgccgcgtgtgtgaagaaggcctttgggttgtaaagcactttcagtatggaggaagtgtagtatgttaacagcatgctgcattgacgttacatacagaagaagcaccggctaactccgtgccagcagccgcggtaatacggagggtgcgagcgttaatcggaataactgggcgtaaagagctcgtaggcggtttgtcaagtcagatgtgaaagccccgggcttaacctgggaaccgcatttgaaactgacagactagagtactgtagagggaggtagaattccaggtgtagcggtgaaatgcgtagatatctggaggaataccggtggcgaaggcggcctcctggacagagactgacgctgaggagcgaaagcgtggggagcaaacaggattagataccctggtagtccacgccgtaaacgatgtcaattagaagcatgttgccatgagtagtgtgtttctaagctaacgcgataaattgaccgcctggggagtacggccggcaaggttaaaactcaaatgaattgacgggggcccgcacaagcggtggagcatgtggtttaattcgatgcaacgcgaagaaccttacctggacttgacatattgagaagtatttagagatagatacgtgccgcaaggagctcaaatacaggtgctgcatggctgtcgtcagctcgtgtcgtgagatgttgggttaagtcccgcaacgagcgcaacccttgttctttgttgccagcacgtaaaggtgggaactcaaagaagactgccggtgacaaaccggaggaaggcagggatgacgtcaagtcatcatggcccttacgtccagggctacacacgtgctacaatgggttgtacagagggaagcgaagtcgcgaggtagagcggaacccagaaagcaactcgtagtccggattggagtctgcaactcgactccatgaagtcggaatcgctagtaatcgcgaatcagaatgtcgcggtgaatacgttcccgggccttgtacacaccgcccgtcacaccatgggagtgaattgcaccagaagtagttagcttaacccgcaagggagggcgattaccacggtgtggtttatgactggggtgaagtcgtaacaaggtaaccataggggaacctgtggttggatcacctcctta

SEQ ID NO: 1655 - DNA, 1014 bp, Ruminococcaceae bacterium D16
  modified_base (907)..(907): a, c, t, g, unknown or other
  modified_base (907)..(907): a, c, t, g, unknown or other
  modified_base (910)..(910): a, c, t, g, unknown or other
  modified_base (910)..(910): a, c, t, g, unknown or other
  modified_base (953)..(955): a, c, t, g, unknown or other
  modified_base (953)..(955): a, c, t, g, unknown or other
  modified_base (973)..(973): a, c, t, g, unknown or other
  modified_base (973)..(973): a, c, t, g, unknown or other
  modified_base (980)..(981): a, c, t, g, unknown or other
  modified_base (980)..(981): a, c, t, g, unknown or other
  modified_base (996)..(996): a, c, t, g, unknown or other
  modified_base (996)..(996): a, c, t, g, unknown or other
  modified_base (1002)..(1002): a, c, t, g, unknown or other
  modified_base (1002)..(1002): a, c, t, g, unknown or other
tgcctttgaagaggattcgtccaattgataaggttacttagtggcggacgggtgagtaacgcgtgaggaacctgccttggagtggggaataacacagtgaaaattgtgctaataccgcataatgcagttgggtcgcatgactctgactgccaaagatttatcgctctgagatggcctcgcgtctgattagctagttggtggggtaacggcccaccaaggcgacgatcagtagccggactgagaggttggccggccacattgggactgagacacggcccagactcctacgggaggcagcagtggggaatattgggcaatgggcgcaagcctgacccagcaacgccgcgtgaaggaagaaggctttcgggttgtaaacttcttttcttagggacgaagcaagtgacggtacctaaggaataagccacggctaactacgtgccagcagccgcggtaatacgtaggtggcaagcgttatccggatttactgggtgtaaagggcgtgtaggcgggattgcaagtcagatgtgaaaaccacgggctcaacctgtggcctgcatttgaaactgtagttcttgagtactggagaggcagacggaattcctagtgtagcggtgaaatgcgtagatattaggaggaacaccagtggcgaaggcggtctgctggacagcaactgacgctgaggcgcgaaagcgtggggagcaaacaggattagataccctggtagtccacgctgtaaacgatggatactaggtgtggggggtctgaccccctccgtgccgcagttaacacaataagtatcccacctggggagtacgatcgcaaggttgaaactcaaaggaattgacgggggcccgcacaagcggtggagtatgtggtttaattcgaagcaacgcgaagaaccttaccnggnttgacatcccgaggtccggtctagagatagacctttctcttcnnnacctcggtgacaggtggngcatggnngtcgtcagctcgtgncgtganatgttgggttaa

SEQ ID NO: 1656 - DNA, 1503 bp, Ruminococcus albus
agagtttgatcctggctcaggacgaacgctggcggcacgcttaacacatgcaagtcgaacgagcgaaagagtgcttgcactctctagctagtggcggacgggtgagtaacacgtgagcaatctgcctttcggagagggataccaattggaaacgattgttaatacctcataacataacgaagccgcatgactttgttatcaaatgaatttcgccgaaagatgagctcgcgtctgattaggtagttggtgaggtaacggcccaccaagccgacgatcagtagccggactgagaggttgaacggccacattgggactgagacacggcccagactcctacgggaggcagcagtggggaatattgcacaatgggcgaaagcctgatgcagcgatgccgcgtgagggaagaaggttttaggattgtaaacctctgtctttggggacgataatgacggtacccaaggaggaagctccggctaactacgtgccagcagccgcggtaatacgtagggagcgagcgttgtccggaattactgggtgtaaagggagcgtaggcgggattgcaagtcaggtgtgaaatttaggggcttaacccctgaactgcacttgaaactgtagttcttgagtgaagtagaggtaagcggaattcctagtgtagcggtgaaatgcgtagatattaggaggaacatcagtggcgaaggcggcttactgggctttaactgacgctgaggctcgaaagcgtggggagcaaacaggattagataccctggtagtccacgccgtaaacgatgattactaggtgtggggggactgaccccttccgtgccgcagttaacacaataagtaatccacctggggagtacggccgcaaggctgaaactcaaaggaattgacgggggcccgcacaagcagtggagtatgtggtttaattcgaagcaacgcgaagaaccttaccaggtcttgacatcgtacgcatagcatagagatatgtgaaatcccttcggggacgtatagacaggtggtgcatggttgtcgtcagctcgtgtcgtgagatgttgggttaagtcccgcaacgagcgcaacccttactgttagttgctacgcaagagcactctagcaggactgccgttgacaaaacggaggaaggtggggatgacgtcaaatcatcatgccccttatgacctgggctacacacgtactacaatggctgttaacagagggaagcaaaacagtgatgtggagcaaaaccctaaaagcagtcttagttcggattgtaggctgcaacccgcctacatgaagtcggaattgctagtaatcgcggatcagcatgccgcggtgaatacgttcccgggccttgtacacaccgcccgtcacgccatgggagtcggtaacacccgaagcctgtgttctaaccgcaaggaggaagcagtcgaaggtgggattgatgactggggtgaagtcgtaacaaggtagccgtatcggaaggtgcggctggatcacctcctt

SEQ ID NO: 1657 - DNA, 1391 bp, Ruminococcus bromii
  modified_base (21)..(21): a, c, t, g, unknown or other
  modified_base (21)..(21): a, c, t, g, unknown or other
tcgaacggaacttctttaaanggatttcttcggaatgaatttgattaagtttagtggcggacgggtgagtaacgcgtgagtaacctgcctctaagaggggaataacattctgaaaagaatgctaataccgcataatatatatttatcgcatggtagatatatcaaagatttatcgcttagagatggactcgcgtccgattagttagttggtgaggtaacggctcaccaagaccgcgatcggtagccggactgagaggttgaacggccacattgggactgagacacggcccagactcctacgggaggcagcagtgggggatattgcgcaatgggggaaaccctgacgcagcaacgccgcgtgaaggatgaaggtcttcggattgtaaacttcttttattaaggacgaagaaagtgacggtacttaatgaataagctccggctaactacgtgccagcagccgcggtaatacgtagggagcaagcgttgtccggatttactgggtgtaaagggtgcgtaggcggctttgcaagtcagatgtgaaatctatgggctcaacccatagcctgcatttgaaactgcagagcttgagtgaagtagaggcaggcggaattccccgtgtagcggtgaaatgcgtagagatggggaggaacaccagtggcgaaggcggcctgctgggctttaactgacgctgagcacgaaagcgtgggtagcaaacaggattagataccctggtagtccacgctgtaaacgatgattactaggtgtggggggtctgaccccttccgtgccggagttaacacaataagtaatccacctggggagtacggccgcaaggttgaaactcaaaggaattgacgggggcccgcacaagcagtgggtatgtggtttaattcgaagcaacgcgaagaaccttaccaggtcttgacatcctactaacgagatagagatatgttataggccgtttgggaaaagtagagacaggtggtgcatggttgtcgtcagctcgtgtcgtgagatgttgggttaagtcccgcaacgagcgcaacccttgctattagttgctacgcaagagcactctaataggactgccgttgacaaaacggaggaaggtggggacgacgtcaaatcatcatgccccttatgacctgggctacacacgtactacaatggacattaacagagggaagcaatacagtgatgtggagcaaacccctaaaaatgttctcagttcagattgcaggctgcaacccgcctgtatgaagatggaattgctagtaatcgcagatcagcatgctgcggtgaatacgttcccgggccttgtacacaccgcccgtcacaccatgggagccggtaatacccgaagtcagtagtctaaccgcaaggaggacgct

SEQ ID NO: 1658 - DNA, 1371 bp, Ruminococcus callidus
ttaacacatgcaagtcgaacggagaacattgagcttgcttaatgttcttagtggcggacgggtgagtaacacgtgagtaacctgcctctgagagtgggatagcttctggaaacggatggtaataccgcataacatcatggattcgcatgtttctgtgatcaaagatttatcgcttagagatggactcgcgtctgattagctagttggtaaggtaacggcttaccaaggcgacgatcagtagccggactgagaggttgatcggccacattgggactgagacacggcccagactcctacgggaggcagcagtggggaatattgcacaatgggggaaaccctgatgcagcgatgccgcgtggaggaagaaggttttcggattgtaaactcctgttgaagaggacgataatgacggtactcttttagaaagctccggctaactacgtgccagcagccgcggtaatacgtagggagcgagcgttgtccggaattactgggtgtaaagggagcgtaggcgggatggcaagtcagatgtgaaaactatgggctcaacccatagactgcatttgaaactgttgttcttgagtgaggtagaggtaagcggaattcctggtgtagcggtgaaatgcgtagagatcaggaggaacatcggtggcgaaggcggcttactgggcctttactgacgctgaggctcgaaagcgtggggagcaaacaggattagataccctggtagtccacgccgtaaacgatgattactaggtgtggggggactgaccccttccgtgccgcagttaacacaataagtaatccacctggggagtacggccgcaaggttgaaactcaaaggaattgacgggggcccgcacaagcagtggagtatgtggtttaattcgaagcaacgcgaagaaccttaccaggtcttgacatcgagtgacgtacctagagataggtattttcttcggaacacaaagacaggtggtgcatggttgtcgtcagctcgtgtcgtgagatgttgggttaagtcccgcaacgagcgcaacccttaccattagttgctacgcaagagcactctaatgggactgccgttgacaaaacggaggaaggtggggatgacgtcaaatcatcatgccccttatgacctgggctacacacgtactacaatggcaatataacagagggaagcaatacagcgatgtggagcaaatccccaaaaattgtcccagttcagattgcaggctgcaactcgcctgcatgaagtcggaattgctagtaatcgcagatcagcatgctgcggtgaatacgttcccgggccttgtacacaccgcccgtcacaccatgggagtcggtaacacccaaagccggtcgtctaacctt

SEQ ID NO: 1659 - DNA, 1494 bp, Ruminococcus champanellensis
agagtttgatcctggctcaggacgaacgctggcggcacgcctaacacatgcaagtcgaacggagataaagacttcggtttttatcttagtggcggacgggtgagtaacacgtgagcaacctgcctctgagagagggatagcttctggaaacggatggtaatacctcataacatagcggtaccgcatgatactgctatcaaagatttatcgctcagagatgggctcgcgtctgattagctagatggtgaggtaacggctcaccatggcgacgatcagtagccggactgagaggttgaacggccacattgggactgagacacggcccagactcctacgggaggcagcagtggggaatattgcacaatgggcgcaagcctgatgcagcgatgccgcgtggaggaagaaggttttcggattgtaaactcctgtcttaagggacgataatgacggtaccttaggaggaagctccggctaactacgtgccagcagccgcggtaatacgtagggagcgagcgttgtccggaattactgggtgtaaagggagcgtaggcgggattgcaagtcagatgtgaaaactatgggcttaacccatagactgcatttgaaactgtagttcttgagtgaagtagaggtaagcggaattcctagtgtagcggtgaaatgcgtagatattaggaggaacatcggtggcgaaggcggcttactgggcttttactgacgctgaggctcgaaagcgtggggagcaaacaggattagataccctggtagtccacgctgtaaacgatgattactaggtgtggggggactgaccccttccgtgccgcagttaacacaataagtaatccacctggggagtacggccgcaaggttgaaactcaaaggaattgacgggggcccgcacaagcagtggagtatgtggtttaattcgaagcaacgcgaaaaaccttaccaggtcttgacatcgagtgaatgatctagagatagatcagtccttcgggacacaaagacaggtggtgcatggttgtcgtcagctcgtgtcgtgagatgttgggttaagtcccgcaacgagcgcaacccttacctttagttgctacgcaagagcactctagagggactgccgttgacaaaacggaggaaggtggggatgacgtcaaatcatcatgccccttatgacctgggctacacacgtactacaatggcaatgaacagagggaagcaatacagtgatgtggagcaaatccccaaaaattgtcccagttcagattgtaggctgcaactcgcctacatgaagtcggaattgctagtaatcgcagatcagcatgctgcggtgaatacgttcccgggccttgtacacaccgcccgtcacaccatgggagtcggtaacacccgaagccagtagcctaaccgcaaggagggcgctgtcgaaggtgggattgatgactggggtgaagtcgtaacaaggtagccgtatcggaaggtgcggctggatcacct

SEQ ID NO: 1660 - DNA, 1388 bp, Ruminococcus flavefaciens
  modified_base (157)..(157): a, c, t, g, unknown or other
  modified_base (157)..(157): a, c, t, g, unknown or other
  modified_base (276)..(276): a, c, t, g, unknown or other
  modified_base (276)..(276): a, c, t, g, unknown or other
gctggcggcacgcttaacacatgcaagtcgaacggagataatttgagtttacttaggttatcttagtggcggacgggtgagtaacacgtgagcaacctaccttagagagagggatagcttctggaaacggatggtaatacctcataacataactganccgcatgatttagttatcaaagatttatcactctgagatgggctcgcgtctgattagatagttggtgaggtaacggctcaccaagtcgacgatcagtagccggactgagaggttgaacngccacattgggactgagacacggcccagactcctacgggaggcagcagtggggaatattgcacaatgggggaaaccctgatgcagcgatgccgcgtggaggaagaaggttttcggattgtaaactcctgtcttaaaggacgataatgacggtactttaggaggaagctccggctaactacgtgccagcagccgcggtaatacgtagggagcgagcgttgtccggaattactgggtgtaaagggagcgtaggcgggagcgcaagtcagatgtgaaatacatgggctcaacccatgggctgcatttgaaactgtgtttcttgagtgaagtagaggtaagcggaattcctggtgtagcggtgaaatgcgtagatatcaggaggaacaccggtggcgaaggcggcttactgggcttttactgacgctgaggctcgaaagcgtggggagcaaacaggattagataccctggtagtccacgctgtaaacgatgattactaggtgtggggggactgaccccttccgtgccgcagttaacacaataagtaatccacctggggagtacgsccscaaggttgaaactcaaaggaattgacgggggcccgcacaagcagtggagtatgtggtttaattcgaagcaacgcgaagaaccttaccaggtcttgacatcgtatgcatagtctagagatagatgaaattccttcggggacatatagacaggtggtgcatggttgtcgtcagctcgtgtcgtgagatgttgggttaagtcccgcaacgagcgcaacccttacctttagttgctacgcaagagcactctaaagggactgccgttgacamaacggaggaaggtggggatgacgtcaaatcatcatgccccttatgacctgggctacacacgtactacaatggcaattaacaaagagaagcaagacggtgacgtggagcgaatctcaccaaattgtcccagttcagattgcaggctgcaactcgcctgcatgaagtcggaattgctagtaatcgcggatcagcatgccgcggtgaatacgttcccgggccttgtacacaccgcccgtcacaccatgggagtcggtaacacccgaagtcggtagtctaacagc

SEQ ID NO: 1661 - DNA, 1392 bp, Ruminococcus gnavus
  modified_base (1378)..(1380): a, c, t, g, unknown or other
  modified_base (1378)..(1380): a, c, t, g, unknown or other
gtcgagcgaagcacttttgcggatttcttcggattgaagcaattgtgactgagcggcggacgggtgagtaacgcgtgggtaacctgcctcatacagggggataacagttggaaacggctgctaataccgcataagcgcacagtaccgcatggtaccgtgtgaaaaactccggtggtatgagatggacccgcgtctgattagctagttggtggggtaacggcctaccaaggcgacgatcagtagccgacctgagagggtgaccggccacattgggactgagacacggcccaaactcctacgggaggcagcagtggggaatattgcacaatgggggaaaccctgatgcagcgacgccgcgtgagcgatgaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcatggcaagccagatgtgaaagcccggggctcaaccccgggactgcatttggaactgtcaggctagagtgtcggagaggaaagcggaattcctagtgtagcggtgaaatgcgtagatattaggaggaacaccagtggcgaaggcggctttctggacgatgactgacgttgaggctcgaaagcgtggggagcaaacaggattagataccctggtagtccacgccgtaaacgatgaatactaggtgtcgggtggcaaagccattcggtgccgcagcaaacgcaataagtattccacctggggagtacgttcgcaagaatgaaactcaaaggaattgacggggatccgcacaagcggtggagcatgtggtttaattcgaagcaacgcgaagaaccttacctggtcttgacatccctctgaccgctctttaatcggagctttccttcgggacagaggagacaggtggtgcatggttgtcgtcagctcgtgtcgtgagatgttgggttaagtcccgcaacgagcgcaacccctatctttagtagccagcatttaagatgggcactctagagagactgccagggataacctggaggaaggtggggatgacgtcaaatcatcatgccccttatgaccagggctacacacgtgctacaatggcgtaaacaaagggaagcgagcccgcgagggggagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaacnnnaaggagggagct

SEQ ID NO: 1662 - DNA, 1373 bp, Ruminococcus hansenii
tatcattgactcttcggaagatttgatatttgactgagcggcggacgggtgagtaacgcgtgggtaacctgcctcatacaggggaataacagttagaaatggctgctaatgccgcataagcgcacaggaccgcatggtctggtgtgaaaaactgaggtggtatgagatggacccgcgtctgattaggtagttggtggggtaacggcctaccaagccgacgatcagtagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagaaaagacggtacctgactaagaagccccggctaactacgtgccagcagccgcggtaatacgtagggggcaagcgttatccggatttactgggtgtaaagggagcgtagacggaagagcaagtctgatgtgaaaggctggggcttaaccccaggactgcattggaaactgtttttctagagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcggggtgcaaagcagttcggtgccgcagcaaacgcaataagtattccacctggggagtacgttcgcaagaatgaaactcaaaggaattgacggggacccgcacaagcggtggagcatgtggtttaattcgaagcaacgcgaagaatcttaccaagtcttgacatctgcctgaccgtcccttaaccggagctttccttcgggacaggcaagacaggtggtgcatggttgtcgtcagctcgtgtcgtgagatgttgggttaagtcccgcaacgagcgcaacccctatccttagtagccagcagtccggctgggcactctagggagactgccggggataacccggaggaaggcggggacgacgtcaaatcatcatgccccttatgatttgggctacacacgtgctacaatggcgtaaacaaagggaagcgaagcggtgacgcttagcaaatctcaaaaataacgtcccagttcggactgcagtctgcaactcgactgcacgaagctggaatcgctagtaatcgcgaatcagaatgtcgcggtgaatacgttcccgggtcttgtacacaccgcccgtcacaccatgggagtcagtaacgcccgaagtcagtgacccaaccttatggaggga

SEQ ID NO: 1663 - DNA, 1386 bp, Ruminococcus lactaris
tcgagcgaagcacttaggaaagattcttcggatgatttcctatttgactgagcggcggacgggtgagtaacgcgtgggtaacctgcctcatacagggggataacagttagaaatgactgctaataccgcataagaccacagcaccgcatggtgcaggggtaaaaactccggtggtatgagatggacccgcgtctgattagttagttggtggggtaacggcctaccaaggcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggagcagcaagtctgatgtgaaaacccggggctcaaccccgggactgcattggaaactgttgatctggagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgactactaggtgtcgggtggcaaagccattcggtgccgcagccaacgcaataagtagtccacctggggagtacgttcgcaagaatgaaactcaaaggaattgacggggacccgcacaagcggtggagcatgtggtttaattcgaagcaacgcgaagaaccttacctgctcttgacatcccggtgacggcagagtaatgtctgcttttcttcggaacaccggtgacaggtggtgcatggttgtcgtcagctcgtgtcgtgagatgttgggttaagtcccgcaacgagcgcaacccctatcttcagtagccagcggtaaggccgggcactctggagagactgccagggataacctggaggaaggtggggatgacgtcaaatcatcatgccccttatgagcagggctacacacgtgctacaatggcgtaaacaaagggaagcgaacccgcgagggtgggcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagg

SEQ ID NO: 1664 - DNA, 1373 bp, Ruminococcus obeum
  modified_base (8)..(8): a, c, t, g, unknown or other
  modified_base (8)..(8): a, c, t, g, unknown or other
  modified_base (762)..(762): a, c, t, g, unknown or other
  modified_base (762)..(762): a, c, t, g, unknown or other
  modified_base (899)..(899): a, c, t, g, unknown or other
  modified_base (899)..(899): a, c, t, g, unknown or other
acgggaantacttcattgagacttcggtggatttgatttagtattctagtggcggacgggtgagtaacgcgtgggtaacctgccttatacagggggataacagtcagaaatgactgctaataccgcataagcgcacaggaccgcatggtccggtgtgaaaaactccggtggtataagatggacccgcgttggattagcttgttggtggggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggcaactacgtgccagcagccgcggtaatacgtagggggcaagcgttatccggtttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgttgaggctgaaagcgtggggagcaaacaggattagataccctggtagtccacgccgtaaacgatgaatataggtgtcgggatgntcggtgccgtcgcaaacgcagtaagtattccacctggggagtacgttcgcaagaatgaaactcaaaggaattgacggggacccgcacaagcggtggagcatgtggtttaattcgaagcaacgcgaagaaacatggcnagtcttgacatccctttgaccgacttttaaccgagtttttccttcgggacagaggagacaggtggtgcatggttgttgtcagctcgtgtcgtgagatgttgggttaagtcccgcaacgagcgcaacccctatcctcagtagccagcaagttgagttgggcactctgtggagactgccagggataacctggaggaaggcggggatgacgtcaaatcatcatgccccttatgatttgggctacacacgtgctacaatggcgtaaacaaagggaagcgagattgtgagatggagcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagtaacgcccgaagtcagtgacctaactgcaaagaagg

SEQ ID NO: 1665 - DNA, 1368 bp, Ruminococcus sp.
  18P13
tcgaacggagataaagacttcggtttttatcttagtggcggacggttgagtaacacgtgagcaacctgcctttgagagagggatagcttctggaaacggatggtaatacctcataacatagcggtaccgcatgatactgctatcaaagatttatcgctcagagatgggctcgcgtctgattagctagatggtgaggtaacggttcaccatggcgacgatcagtagccggactgagaggttgaacggccacattgggactgagacacggcccagactcctacgggaggcagcagtgcggaatattgcacaatgacgcaagcctgatgcagcgatgccgcgtggaggaagaaggttttcggattgtaaactcctgtcttaagggacgataatgacggtaccttaggaggaagctccggctaactacgtgccagcagccgcggtaatacgtagggagcgagcgttgtccggaattactgggtgtaaagggagcgtaggcgggattgcaagtcagatgtgaaaactatgggcttaacccatagactgcatttgaaactgtagttcttgagtgaagtagaggtaagcggaattcctagtgtagcggtgaaatgcgtagatattaggaggaacatcggtggcgaaggcggcttactgggcttttactgacgctgaggctcgaaagcgtggggagcaaacaggattagataccctggtagtccacgctgtaaacgatgattactaggtgtggggggactgaccccttccgtgccgcagttaacacaataagtaatccacctggggagtacggccgcaaggttgaaactcaaaggaattgacgggggcccgcacaagcagtggagtatgtggtttaattcgaagcaacgcgaaaaaccttaccaggtcttgacatcgagtgaatgatctagagatagatcagtccttcgggacacaaagacaggtggtgcatggttgtcgtcagctcgtgtcgtgagatgttgggttaagtcccgcaacgagcgcaacccttacctttagttgctacgcaagagcactctagagggactgccgttgacaaaacggaggaaggtggggatgacgtcaaatcatcatgccccttatgacctgggctacacacgtactacaatggcaatgaacagagggaagcaatacagtgatgtggagcaaatccccaaaaattgtcccagttcagattgtaggctgcaactcgcctacatgaagtcggaattgctagtaatctgcagctcagcatgctgcggtgaatacgttcccgggccttgtacacgccgcccgtcacaccatgggagtcggtaacacccgaagccagtagcctaaccgcaaggagggcgctgt

SEQ ID NO: 1666 - DNA, 1368 bp, Ruminococcus sp.
  5_1_39BFAA
  modified_base (8)..(8): a, c, t, g, unknown or other
  modified_base (8)..(8): a, c, t, g, unknown or other
  modified_base (10)..(11): a, c, t, g, unknown or other
  modified_base (10)..(11): a, c, t, g, unknown or other
  modified_base (15)..(15): a, c, t, g, unknown or other
  modified_base (15)..(15): a, c, t, g, unknown or other
  modified_base (20)..(20): a, c, t, g, unknown or other
  modified_base (20)..(20): a, c, t, g, unknown or other
  modified_base (762)..(762): a, c, t, g, unknown or other
  modified_base (762)..(762): a, c, t, g, unknown or other
acgggaantnnttcnttganacttcggtggatttagatttatttctagtggcggacgggtgagtaacgcgtgggtaacctgccttatacagggggataacagtcagaaatggctgctaataccgcataagcgcacagagctgcatggctcagtgtgaaaaactccggtggtataagatggacccgcgttggattagctggttggtggggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggagggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactagtgtcggcaantcggtgccgtcgcaaacgcagtaagtattccacctggggagtacgttcgcaagaatgaaactcaaaggaattgacggggaccgcacaagcggtggacatgtggtttaattcgaagcaacgcgaagaaccttaccaagtcttgacatccgcctgaccgatccttaaccggatctttccttcgggacaggcgagacaggtggtgcatggttgtcgtcagctcgtgtcgtgagatgttgggttaagtcccgcaacgagcgcaacccctatcctcagtagccagcatttaaggtgggcactctggggagactgccagggataacctggaggaaggcggggatgacgtcaaatcatcatgccccttatgatttgggctacacacgtgctacaatggcgtaaacaaagggaagcgagattgtgagatggagcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagtaacgcccgaagtcagtgacctaactgcaaagaa

SEQ ID NO: 1667 - DNA, 1223 bp, Ruminococcus sp.
  9SE51
cacgcctaacacatgcaagtcgaacgagtggcggacgggtgagtaacacgtgagcaacctgcctctgagagagggatagcttctggaaacggatggtaatacctcataaccaaagtcgctcagagatggtctcgcgtctgattagctagatggtgaggtaacggctcaccatggcgacgatcagtagccggactgagaggttgaacggccacattgggactgagacacggccagactcctacgggaggcagcagtggggaatattgcacaatgggcgcaagcctgatgcagcgatgccgcgtggaggaagaaggttttcggattgtaaactcctgtcttaagggacgatgacggtaccttaggaggaagctccggctaactacgtgccagcagccgcggtaatacgtagggagcgagcgttgtccggaattactgggtgtaaagggagcgtaggcgggattgcaagtcagatgtgaaaactatgggcttaacccatagactgcatttgaaactgtagttcttgagtgaagtagaggtaagcggaattcctagtgtagcggtgaaatgcgtagatattaggaggaacatcggtggcgaaggcggcttactgggcttactgacgctgaggctcgaaagcgtggggagcaaacaggattagataccctggtagtccacgctgtaaagatgattactaggtgtgggggcttccgtgccgcagttaacacaataagtaatccacctggggagtacggccgcaaggttgaaactcaaaggaattgacgggggcccgcacaagcagtggagtatgtggtttaattcgaagcaacgcgaaaaaccttaccaggtcttgacatcgacaggtggtgcatggttgtcgtcagctcgtgtcgtgagatgttgggttaagtcccgcagcgagcgcaacccttacctttagttgctacagcactctagagggactgccgttgacaaaacggaggaaggtggggatgtcgtcaaatcatcatgccccttatgactgggctacacacgtactacaatggcaatcagagggaagcaatacagtgatgtggagcaaatccccattgtcccagttcagatgtaggctcaactcgcctacagaagtcggaattgctagtaatcgcagctcagcatgccgcggtgaatacgttaacgggccttgtacacggcgcccgtcacaccatgggagtcggtaacaaccg

SEQ ID NO: 1668 - DNA, 1339 bp, Ruminococcus sp.
  ID8
  modified_base (27)..(27): a, c, t, g, unknown or other
  modified_base (27)..(27): a, c, t, g, unknown or other
ggaggaagaggacagtgactgagcggnggacgggtgagtaacggcggtgggcaacctgcctcatacagggggataacagttagaaatgactgctaataccgcataagcgcacaggaccgcatggtgtagtgtgaaaaactccggtggtatgagatggacccgcgtctgattaggtagttggtggggtaaaggcctaccaagccgacgatcagtagccgacctgagagggtgaccggccacattgggactgagacacggcccaaactcctacgggaggcagcagtggggaatattgcacaatgggggaaaccctgatgcagcgacgccgcgtgaaggaagaagtatttcggtatgtaaacttctatcagcagggaagaagatgacggtacctgagtaagaagcaccggctaaatacgtgccacagccgcggtaatacgtatggtgcagcgttatccggatttactgggtgtaaagggagcgtagacggataggcaagtctggagtgaaaacccagggctcaaccctgggactgctttggaaactgcagatctggagtgccggagaggtaagcggaattcctagtgtagcggtgaaatgcgtagatattaggaggaacaccagtggcgaaggcggcttactggacggtgactgacgttgaggctcgaaagcgtggggagcaaacaggattagataccctggtagtccacgccgtaaacgatgactactagtgtcggtgtgcaaagcacatcggtgccgcagcaaacgcaataagtagtccacctggggagtacgttcgcaagaatgaaactcaaaggaattgaccgggacccgcacaagcggtggagcatgtggtttaattcgaagcaacgcgaagaaccttacctggtcttgacatccggatgacgggcgagtaatgtcgccgtcccttcggggcatccgagacaggtggtgcatggttgtcgtcagctcgtgtcgtgagatgttgggttaagtcccgcaacgagcgcaacccttatcttcagtagccagcatataaggtgggcactctggagagactgccagggagaacctggaggaaggtggggatgacgtcaaatcatcatgccccttatggccagggctacacacgtgctacaatggcgtaaacaaagggaagcgagagggtgacctggagcgaatcccaaaaataacgtctcagttcggattgtagtctgcaactcgactacatgaagctggaatcgctagtaatcgcggatcagcatgccgcggtgaatacgttcccgggtcttgtacacaccgcccgtcacaccatgggagtcagtaacgcccgaagccagtg

SEQ ID NO: 1669 - DNA, 898 bp, Ruminococcus sp.
  K-1
  modified_base (719)..(720): a, c, t, g, unknown or other
  modified_base (719)..(720): a, c, t, g, unknown or other
  modified_base (723)..(723): a, c, t, g, unknown or other
  modified_base (723)..(723): a, c, t, g, unknown or other
  modified_base (824)..(824): a, c, t, g, unknown or other
  modified_base (824)..(824): a, c, t, g, unknown or other
  modified_base (877)..(877): a, c, t, g, unknown or other
  modified_base (877)..(877): a, c, t, g, unknown or other
gtggcggacgggtgagtaacgcgtgggtaacctgccttatacagggggataacagtcagaaatggctgctaataccgcataagcgcacagagctgcatggctcagtgtgaaaaactccggtggtataagatggacccgcgttggattagcttgttggtggggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcggggagcnnagntcttcggtgccgtcgcaaacgcagtaagtattccacctggggagtacgttcgcaagaatgaaactcaaaggaattgacggggacccgcacaagcggtggancatgtggtttaattcgaagcaacgcgaagaaccttaccaagtcttgacatccncctgaccgatccttaaccgga

SEQ ID NO: 1670 - DNA, 1361 bp, Ruminococcus torques
ggatgaagaggattgtgactgagcggcggacgggtgagtaacgcgtgggtaacctgcctcatacagggggataacagttagaaatgactgctaataccgcataagaccacagcaccgcatggtgcgggggtaaaaactccggtggtatgagatggacccgcgtctgattagctagttggtaaggtaacggcttaccaaggcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaaaatgacggtacctgactaagaagcaccggctaaatacgtgccagcagccgcggtaatacgtatggtgcaagcgttatccggatttactgggtgtaaagggagcgtagacggatgggcaagttgatgtgaaaacccggggctcaaccccgggactgcattggaaactgttcatctagagtgctggagaggtaagtggaattcctagtgtagcggtgaaatgcgtagatattaggaggaacaccagtggcgaaggcggcttactggacagtaactgacgttgaggctcgaaagcgtggggagcaaacaggattagataccctggtagtccacgccgtaaacgatgactactaggtgtcgggtggcaaagccattcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgctcttgacatcccgctgaccggacggtaatgcgtccttcccttcggggcagcggagacaggtggtgcatggttgtcgtcagctcgtgtcgtgagatgttgggttaagtcccgcaacgagcgcaacccctatctttagtagccagcggccaggccgggcactctagagagactgccggggataacccggaggaaggtggggatgacgtcaaatcatcatgccccttatgagcagggctacacacgtgctacaatggcgtaaacaaagggaagcgagaccgcgaggtggagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagct

SEQ ID NO: 1671 - DNA, 1375 bp, Saccharomonospora viridis
  modified_base (95)..(95): a, c, t, g, unknown or other
  modified_base (95)..(95): a, c, t, g, unknown or other
  modified_base (128)..(128): a, c, t, g, unknown or other
  modified_base (128)..(128): a, c, t, g, unknown or other
  modified_base (155)..(155): a, c, t, g, unknown or other
  modified_base (155)..(155): a, c, t, g, unknown or other
  modified_base (167)..(167): a, c, t, g, unknown or other
  modified_base (167)..(167): a, c, t, g, unknown or other
  modified_base (293)..(293): a, c, t, g, unknown or other
  modified_base (293)..(293): a, c, t, g, unknown or other
  modified_base (341)..(341): a, c, t, g, unknown or other
  modified_base (341)..(341): a, c, t, g, unknown or other
  modified_base (776)..(776): a, c, t, g, unknown or other
  modified_base (776)..(776): a, c, t, g, unknown or other
  modified_base (854)..(854): a, c, t, g, unknown or other
  modified_base (854)..(854): a, c, t, g, unknown or other
  modified_base (890)..(890): a, c, t, g, unknown or other
  modified_base (890)..(890): a, c, t, g, unknown or other
  modified_base (917)..(917): a, c, t, g, unknown or other
  modified_base (917)..(917): a, c, t, g, unknown or other
  modified_base (920)..(920): a, c, t, g, unknown or other
  modified_base (920)..(920): a, c, t, g, unknown or other
  modified_base (1001)..(1001): a, c, t, g, unknown or other
  modified_base (1001)..(1001): a, c, t, g, unknown or other
  modified_base (1030)..(1031): a, c, t, g, unknown or other
  modified_base (1030)..(1031): a, c, t, g, unknown or other
  modified_base (1172)..(1172): a, c, t, g, unknown or other
  modified_base (1172)..(1172): a, c, t, g, unknown or other
  modified_base (1179)..(1179): a, c, t, g, unknown or other
  modified_base (1179)..(1179): a, c, t, g, unknown or other
  modified_base (1181)..(1181): a, c, t, g, unknown or other
  modified_base (1181)..(1181): a, c, t, g, unknown or other
  modified_base (1289)..(1290): a, c, t, g, unknown or other
  modified_base (1289)..(1290): a, c, t, g, unknown or other
  modified_base (1292)..(1292): a, c, t, g, unknown or other
  modified_base (1292)..(1292): a, c, t, g, unknown or other
  modified_base (1294)..(1294): a, c, t, g, unknown or other
  modified_base (1294)..(1294): a, c, t, g, unknown or other
  modified_base (1298)..(1298): a, c, t, g, unknown or other
  modified_base (1298)..(1298): a, c, t, g, unknown or other
  modified_base (1333)..(1333): a, c, t, g, unknown or other
  modified_base (1333)..(1333): a, c, t, g, unknown or other
  modified_base (1354)..(1354): a, c, t, g, unknown or other
  modified_base (1354)..(1354): a, c, t, g, unknown or other
tgagtggcgaacgggtgagtaacacgtgggtaatctgccctgtactctgggataagcctgggaaactgggtctaataccggataggcaccagctnccgcatggtggtgtgtggaaagctgcggcggtncaggatgagccggcggcccatcagctngttggtggggtnatggcctaccaaggcgacgacgggtagccggcctgagagggtgaccggccacactgggactgagacacggcccagactcctaccggaggcagcagtggggaatattgcacaatggacggaagcctnatgcagcgacgccgcgtgggggatgacggccttcgggttgtaaacccntttcgcccgggacgaagcgagagtgacggtaccgggagaagaagcaccggctaactacgtgccagcagccgcggtaatacgtagggtgcaagcgtggtccggaatgattgggcgtaaagagctcgtaggcggtgtgtcgcgtctgccgtgaaaacctgcggctgaaccgtgggcgtgcggtggatacgggcacactggagttcggtaggggagactggaattcctggtgtagcggtgaaatgcgcagatatcaggaggaacgccagtggcgaaggcggggctctgggccgaaactgacgctgaggagcgaaagcgtggggagcgaacaggattagataccctggtagtccacgccgtaaacggtgggcgctaggtgtgggatgctgtgcacgtgtcccgtgccgtagctaacgcatgaagcgccccgcctggggngtacggccgcaaggctaaaactcaaaggaatggacgggggcccgcacaagcggcggagcatgtggattaattcgatgnaacgcgaagaacctgacctgggtgggacatgcactngaccggcgtagagatacgccggccctngtngctggtgcacaggtggtgcatggctgtcgtcagctcgtgtcgtgagatgttgggttaagtcccgcaacgagcgcaaccctngtcccatgttgccagcgggtaatgccggnnactcgtgggagactgccggggttaactcggaggaaggtggggatgacgtcaagtcatcatgccccttatgcccagggctgcacacatgctacaatggccagtacagagggtggcgagaccgtgaggtggagcgaatcccgnaaagctngnctgagttcggatcgtggtctgcaactcgactgcgtgaagtcggagtcgctagtaatcgcagatcagcaacgctgcggtgaatrcgttcccgggccttgtacacaccgnncntnacgncatgaaagtcggtaacacccgaagcccatggcctnaccccgtcaggggagggagtngtcgaaggtgggacccgcgat

SEQ ID NO: 1672 - DNA, 1545 bp, Salmonella enterica
ttaaattgaagagtttgatcatggctcagattgaacgctggcggcaggcctaacacatgcaagtcgaacggtaacaggaagcagcttgctgcttcgctgacgagtggcggacgggtgagtaatgtctgggaaactgcctgatggagggggataactactggaaacggtggctaataccgcataacgtcgcaagaccaaagagggggaccttcgggcctcttgccatcagatgtgcccagatgggattagctagttggtgaggtaacggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccgcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtctacttggaggttgtgcccttgaggcgtggcttccggagctaacgcgttaagtagaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcgattaggtcgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttac

SEQ ID NO: 1673 - DNA, 1545 bp, Salmonella enterica; identical to SEQ ID NO: 1672

SEQ ID NO: 1674 - DNA, 1545 bp, Salmonella enterica; identical to SEQ ID NO: 1672

SEQ ID NO: 1675 - DNA, 1545 bp, Salmonella enterica; identical to SEQ ID NO: 1672

SEQ ID NO: 1676 - DNA, 1545 bp, Salmonella enterica; identical to SEQ ID NO: 1672

SEQ ID NO: 1677 - DNA, 1545 bp, Salmonella enterica; identical to SEQ ID NO: 1672

SEQ ID NO: 1678 - DNA, 1545 bp, Salmonella enterica; identical to SEQ ID NO: 1672

SEQ ID NO: 1679 - DNA, 1545 bp, Salmonella enterica; identical to SEQ ID NO: 1672

SEQ ID NO: 1680 - DNA, 1545 bp, Salmonella enterica; identical to SEQ ID NO: 1672

SEQ ID NO: 1681 - DNA, 1416 bp, Salmonella typhimurium
catgcaagtcgaacggtaacaggaagcagcttgctgcttcgctgacgagtggcggacgggtgagtaatgtctgggaaactgcctgatggagggggataactactggaaacggtggctaataccgcataacgtcgcaagaccaaagagggggaccttcgggcctcttgccatcagatgtgcccagatgggattagcttgttggtgaggtaacggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccgcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtctacttggaggttgtgcccttgaggcgtggcttccggagctaacgcgttaagtagaccgcctggggagtacggccgcaaggttaaaactcaaatgaattgacgggggcccgcacaagcggtggagcatgtggtttaattcgatgcaacgcgaagaaccttacctggtcttgacatccacagaagtttccagagatggattggtgccttcgggaactgtgagacaggtgctgcatggctgtcgtcagctcgtgttgtgaaatgttgggttaagtcccgcaacgagcgcaacccttatcctttgttgccagcgattaggtcgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccac

SEQ ID NO: 1682 - DNA, 1545 bp, Salmonella enterica; identical to SEQ ID NO: 1672

SEQ ID NO: 1683 - DNA, 1498 bp, Salmonella bongori
ttgatcatggctcagattgaacgctggcggcaggcctaacacatgcaagtcgaacggtaacaggaagcagcttgctgcttcgctgacgagtggcggacgggtgagtaatgtctgggaaactgcctggtggagggggataactactggaaacggtggctaataccgcataacgtcgcaagaccaaagagggggaccttcgggcctcttgccatcagatgtgcccagatgggattagcttgttggtggggtaacggcccaccaaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcghcaaggttaataaccttgttgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaaccttgtagagatacgagggtgccttcgggaactgtgagacaggtgctgcatggctgtcgtcagctcgtgttgtgaaatgttgggttaagtcccgcaacgagcgcaacccttatcctttgttgccagcgattaggtcgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 1684 - DNA, 1545 bp, Salmonella enterica; identical to SEQ ID NO: 1672

SEQ ID NO: 1685 - DNA, 1545 bp, Salmonella enterica; identical to SEQ ID NO: 1672

SEQ ID NO: 1686 - DNA, 1416 bp, Salmonella typhimurium; identical to SEQ ID NO: 1681

SEQ ID NO: 1687 - DNA, 1363 bp, Sarcina ventriculi
  modified_base (11)..(12): a, c, t, g, unknown or other
  modified_base (11)..(12): a, c, t, g, unknown or other
tcgagcgaganngttcttcggagcttttctagcggcggacgggtgagtaacacgtgggcaacctgcctcatagaggggaatagccttccgaaaggaagattaataccgcataatattgttgaaaggcatcttttaacaatcaaaggagcaatccgctatgagatgggcccgcggcgcattagctagttggtgaggtaacggctcaccaaggcgacgatgcgtagccgacctgagagggtgatcggccacattggaactgagacacggtccagactcctacgggaggcagcagtggggaatattgcacaatgggggaaaccctgatgcagcaacgccgcgtgagtgatgaaggtcttcggattgtaaagctctgtctttagggacgataatgacggtacctaaggaggaagccacggctaactacgtgccagcagccgcggtaatacgtaggtggcaagcgttatccggatttactgggcgtaaagggagcgtaggcggatatttaagtgggatgtgaaatacccgagcttaacttgggagctgcattccaaactggatatctagagtgcaggagaggagaatggaattcctagtgtagcggtgaaatgcgtagagattaggaagaacaccagtggcgaaggcgattctctggactgtaactgacgctgaggctcgaaagcgtggggagcaaacaggattagataccctggtagtccacgccgtaaacgatgaatactaggtgtaggggccccaagcctctgtgccgccgctaacgcattaagtattccgcctggggagtacggtcgcaagattaaaactcaaaggaattgacggggacccgcacaagcagcggagcatgtggtttaattcgaagcaacgcgaagaaccttacctagacttgacctgtcctgaattaccagtaatgtgggaaattccttcgggaacaggaacacaggtggtgcatggttgtcgtcagctcgtgtcgtgagatgttgggttaagtcccgcaacgagcgcaacccttattgttagttggtaccattaagttgaccactctagcgagactgcccgggttaaccgggaggaaggtggggatgacgtcaaatcatcatgccccttatgtctagggctacacacgtgctacaatggcaagtacaaagagaagcaatactgtgaagtggagcaaaactcaaaaacttgtctcagttcggattgtaggctgaaactcgcctacatgaagctggagttgctagtaatcgcgaatcagaatgtcgcggtgaatacgttcccgggtcttgtacacaccgcccgtcacaccatgagagttggcaatacccgaagtccgtaagctaaccgtaaggag

SEQ ID NO: 1688 - DNA, 1557 bp, Scardovia inopinata
  modified_base (967)..(967): a, c, t, g, unknown or other
  modified_base (967)..(967): a, c, t, g, unknown or other
agagtttgatcatggctcaggacgaacgctggcggcgtgcttaacacatgcaagtcgaacgggatcctgcttggtttttgctgggtgggtgagagtggcgaacgggtgagtaatgcgtgactaacctgccgtgtagttgggtatagctcctggaaacgggtggtaataccgaatggtccactgggctgcatggtctggtgggaaagttttgtgtgctatgcgatggggtcgcgtcctatcagcttgttggtggggtgatggcctaccaaggcttcgacgggtagccggcctaagagggcgaccggccacattgggactgagatacgcccagactcctacgggaggcagcagtggggaatattgcacaatggggggaaccctgatgcagcgacgccgcgtgcgggatggaggccttcgggttgtgaaccgcttttattggggagcaagctggccctgtgttgggttggtgagtgtacttggtgaataagcaccggccaactacgtgccagcagccgcggtaatacgtagggtgccagcgttgtccggatttattgggcgtaaagggctcgtaggcggttcgtcgcgtctggtgtgaaagcttactgcttaacggtgggtttgcgttggatacgggcgggcttgagtgcagtaggggagactggaattctcggtgtaacggtggaatgtgtagatatcgggaagaacacctatggcgaaggcaggtctctgggctgttactgacgctgaggagcgaaagcgtggggagcgaacaggattagataccctggtagtccacgctgtaaacggtggacgctggatgtggggcctatttccacgggttctgtgtcggagctaacgcgttaagcgtcccgcctggggagtacggccgcaaggttaaaactcaaagaaattgacgggggcccgcacaagcggcggagcatgcggattaattcgatgcaacgcgaanaaccttaccagggcttgacatgtgagcgttgatcttagagatagggtttcccttcggggcgctttcacaggtggtgcatggtcgtcgtcagctcgtgtcgtgagatgttgggttaagtccccgcaaacgagcgcaacccttgccttgtgttgccagccggttcttgcccggggaactcaacaaagggaaccgcccgggggttaaacttcgggaaggaaagggtgggggatgacgtccagaatcatcatgccccttaacgtcctggggcttcaacgcatgctacaatggctggtacagcggggatgcgatacggtgacgtggagcggatcctgtaaaaccggtctcagttcggatcggagcctgcaactcggctccgtgaaggtggagtcgctagtaatcgcggatcagcagtgccgcggtgaatgcgttcccgggccttgtacacaccgcccgtcaagtcatgaaagtgggcagcacccgaagccggtggcctaacccttgtggggagaaccgtctaaggtgaggttcgcgattgggactaagtcgtaacaaggtagccgtaccggaaggtgcggctggatcacctcctt

SEQ ID NO: 1689 - DNA, 1294 bp, Scardovia wiggsiae
gacgaacgctggcggcgtgcttaacacatgcaagtcgaacgagtggcgaacgggtgagtaatgcgtgactaacctgccgtatggttggggatagctcctggaaacgggtggtaatacccaatgctgaaaggtgccatatgatggggtcgcgtcctatcagcttgttggtggggtgatggcctaccaaggcgtcgacgggtagccggcctaagagggcgaccggccacattgggactgagatacggcccagactcctacgggaggcagcagtggggaatattgcacaatgggcgcaagcctgatgcagcgacgccgcgtgcgggatggaggccttcgggttgtaaaccgcttttataggggggcatgagtggactttatgaataagcaccggctaactacgtgccagcagccgcggtaatacgtagggtgcaagcgttgtccggatttattgggcgtaaagggctcgtaggcggtttgttgcgtctggtgtgaaagcttactgcttaacggtaggttgcgctggatacgggcaggcttgagtgcagtaggggagactggaattctcggtgtaacggtggaatgtgtagatatcgggaagaacacctatggcgaaggcaggtctctgggctgactgacgctgaggagcgaaagcgtggggagcgaacaggattagataccctggtagtccatgctgtaaacggtggacgctggatgtggggcgttctgtgtcggagctaacgcgttaagcgtcccgcctggggagtacggccgcaaggttaaaactcaaagaaattgacgggggcccgcacaagcggcggagcatgcggattaattcgatgcaacgcgaagaaccttaccagggcttgacatatacaggtggtgcatggtcgtcgtcagctcgtgtcgtgagatgttgggttaagtcccgcaacgagcgcaacccttgccttgtgttaccagcggccggggactcacaagggaccgccggggttaactcggaggaaggtggggatgacgtcagatcatcatgccccttacgtcctgggcttcacgcatgctacaatggctggcagcgggatgcgatactgtaaggtggagcggatcctgtccggtctcagttcggacggggcctgcaactcggcctcggaaggtggagtcgctagtaatcgcggatcagcagtgccgcggtgaatgcgttcccgggccttgtacacaccgcccgtcaagtcatgaaagtgggcagcacccgaagccggtgcctagggagccgtctaaggtgaggttcgcgattggg

SEQ ID NO: 1690 - DNA, 1504 bp, Segniliparus rotundus
agagtttgattctggctcaggacgaacgctggcggcgtgcctaacacatgcaagtcgaacggtaaggcccttcggggtacacgagtggcgaacgggtgagtaacacgtgggcaatctgccctgcactctgggataagcctgggaaactgggtctaataccggatatgagtctccaccgcatggcggagactggaaagtttttcggtgcaggatgagcccgcggcctatcagctagttggtggggtaatggcctaccaaggcgacgacgggtagccggcctgagagggtgatcggccacactgggactgagacacggcccagactcctacgggaggcagcagtggggaatattgcacaatgggcgaaagcctgatgcagcgacgccgcgtgcgggatgacggccttcgggttgtaaaccgctttcagcagggacgaagcgcaagtgacggtacctgcaaaagaagcaccggctaactacgtgccagcagccgcggtaatacgtagggtgcgagcgttgttcggaattactgggcgtaaagagctcgtaggcggactgtcgcgtcgcctgtgaaagcccgtggctcaaccacgggtctgcaggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgctgtaaacggtgggcgctaggtgtgggtttccttccatgaaatccgtgccgtagctaacgcattaagcgccccgcctggggagtacggccgcaaggctaaaactcaaagaaattgacgggggcccgcacaagcggcggagcatgtggattaattcgatgcaacgcgaagaaccttacctgggtttgacatggactggaaagccgtagagatacggccccccttgtggtcggttcacaggtggtgcatggctgtcgtcagctcgtgtcgtgagatgttgggttaagtcccgcaacgagcgcaacccttgtcctgtgttgccagcgcgtaatggcggggactctcaggaaactgccggggtcaactcggaggaaggtggggacgacgtcaagtcatcatgccccttatgtccagggcttcacacatgctacaatggcgcgtacagagggcagcgatatcgcaaggtggagcgaatcccttaaagcgcgtctcagttcggattggggtctgcaactcgaccccatgaagtcggagtcgctagtaatcgcagatcagcaacgctgcggtgaatacgttcccgggccttgtacacaccgcccgtcaagtcacgaaagtcggtaacacccgaagccggtggcccaaccttttaggagggagccgtcgaaggtgggattggcgattgggactaagtcgaaacaaggtagccgtaccggaaggtgcggctggatcacct

SEQ ID NO: 1691 - DNA, 1520 bp, Segniliparus rugosus
ctttcacggagagtttgattctggctcaggacgaacgctggcggcgtgcctaacacatgcaagtcgaacgatgaagcccttcggggtggattagtggcgaacgggtgagtaacacgtgggcaatctgccctgcactctgggataagcctgggaaactgggtctaataccggatatgagcttccaccgcatggtggaggttggaaagtttttcggtgcaggatgagcccgcggcctatcagctagttggtggggtaacggcctaccaaggcgacgacgggtagccggcctgagagggtgatcggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcaaaagaagcaccggctaactacgtgccagcagccgcggtaatacgtagggtgcgagcgttgttcggatttactgggcgtaaagagctcgtaggcggactgtcgcgtcgcctgtgaaagcccgtggctcaaccacgggtctgcaggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgctgtaaacggtgggcgctaggtgtgggtttccttccatgaaatccgtgccgtagctaacgcattaagcgccccgcctggggagtacggccgcaaggctaaaactcaaagaaattgacgggggcccgcacaagcggcggagcatgtggattaattcgatgcaacgcgaagaaccttacctgggtttgacatggactggaaagccgtagagatacggccccccttgtggtcggttcacaggtggtgcatggctgtcgtcagctcgtgtcgtgagatgttgggttaagtcccgcaacgagcgcaacccttgtcctgtgttgccagcgcgtaatggcggggactctcaggaaactgccggggtcaactcggaggaaggtggggacgacgtcaagtcatcatgccccttatgtccagggcttcacacatgctacaatggcgcgtacagagggcagcgatatcgcaaggtggagcgaatcccttaaagcgcgtctcagttcggattggggtctgcaactcgaccccatgaagtcggagtcgctagtaatcgcagatcagcaacgctgcggtgaatacgttcccgggccttgtacacaccgcccgtcaagtcacgaaagtcggtaacacccgaagccggtggcccaaccttttaggagggagccgtcgaaggtgggattggcgattgggactaagtcgaaacaaggtagccgtaccggaaggtgcggctggatcacctcctttct

SEQ ID NO: 1692 - DNA, 1520 bp, Selenomonas artemidis
gagtttgatcctggctcaggacgaacgctggcggcgtgcttaacacatgcaagtcgaacggagcgaatgaaagcttgcttttatgagcttagtggcaaacgggtgagtaacacgtagacaacctgccgatcagatggggacaacattccgaaaggaatgctaataccgaatggcgtgtaggggaggcatcttccctacatgaaagatggcctctatatataagctatcactgatcgatgggtctgcgtctgattagctagtaggtaaggtaacggcttacctaggcgacgatcagtagccggtctgagaggatgaacggccacattgggactgagacacggcccagactcctacgggaggcagcagtggggaatcttccgcaatgggcgcaagcctgacggagcaacgccgcgtgagtgaagaaggtcttcggatcgtaaagctctgttgaaggggacgaacgtacataagttgaataagcttatgtaatgacggtaccttttgaggaagccacggctaactacgtgccagcagccgcggtaatacgtaggtggcgagcgttgtccggaatcattgggcgtaaagggagcgcaggcggccatgtaagtcttgcttaaaagttcggggctcaaccccgtgatgggcaagaaactatatggcttgagtgcaggagaggaaagcggaattcccagtgtagcggtgaaatgcgtagatattgggaggaacaccagtggcgaaggcggctttctggactgcaactgacgctgaggctcgaaagccaggggagcgaacgggattagataccccggtagtcctggccgtaaacgatggatactaggtgtgggaggtatcgacccctaccgtgccggagttaacgcaataagtatcccgcctggggagtacggtcgcaagactgaaactcaaaggaattgacggggacccgcacaagcggtggagtatgtggtttaattcgaagcaacgcgaagaaccttaccaggtcttgacattgattgaaaggcgtagagatacgtccctctcttcggagacaagaaaacaggtggtgcatggctgtcgtcagctcgtgtcgtgagatgttgggttaagtcccgcaacgagcgcaacccctgtcctttgttgccagcatgtagtggtgggcactcaaaggagactgccgcggagaacgcggaggaaggcggggatgacgtcaagtcatcatgccccttatgacctgggctacacacgtactacaatgggacggacagagagcagcgagagagcgatcttaagcgaacctcaaaaaccgtttctcagttcggattgcaggctgcaactcgcctgcatgaagtcggaatcgctagtaatcgcaggtcagcatactgcggtgaatacgttcccgggtcttgtacacaccgcccgtcacaccacggaagtcgttcacacccgaagccggcgcagccgtctaaggtggggaaggtgactggggtgaagtcgtaacaaggtagccgtatcggaaggtgcgg

SEQ ID NO: 1693 - DNA, 1520 bp, Selenomonas dianae
gagtttgatcctggctcaggacgaacgctggcggcgtgcttaacacatgcaagtcgaacggagcgaatgaaagcttgcttttatgagcttagtggcaaacgggtgagtaacacgtagacaacctgccgacaggatggggacaacattccgaaaggaatgctaataccgaatgaagcggatgggaggcatctcctatccgtgaaagatggcctctatttataagctatcacctgtcgatgggtctgcgtctgattagctggttggtgaggtaacggctcaccaaggcgacgatcagtagccggtctgagaggatgaacggccacattgggactgagacacggcccagactcctacgggaggcagcagtggggaatcttccgcaatgggcgcaagcctgacggagcaacgccgcgtgagtgaagaaggtcttcggatcgtaaagctctgttgacggggacgaacgtgcgagaggtgaataaactcttgcaatgacggtacctgtcgaggaagccacggctaactacgtgccagcagccgcggtaatacgtaggtggcgagcgttgtccggaatcattgggcgtaaagggagcgcaggcgggcatataagtctttcttaaaagttcggggctcaaccccgtgatgggaaagaaactatgtgtcttgagtacaggagaggaaagcggaattcccagtgtagcggtgaaatgcgtagatattgggaggaacaccagtggcgaaggcggctttctggactgcaactgacgctgaggctcgaaagccaggggagcgaacgggattagataccccggtagtcctggccgtaaacgatggatactaggtgtgggaggtatcgacccctaccgtgccggagttaacgcaataagtatcccgcctggggagtacggtcgcaagactgaaactcaaaggaattgacggggacccgcacaagcggtggagtatgtggtttaattcgaagcaacgcgaagaaccttaccaggccttgacattgactgaaagcgctagagatagctccctctcttcggagacaggaaaacaggtggtgcatggctgtcgtcagctcgtgtcgtgagatgttgggttaagtcccgcaacgagcgcaacccctgttctttgttgccatcacgttatggtgggcactcaaaggagactgccgcggagaacgcggaggaaggcggggatgacgtcaagtcatcatgccccttatggtctgggctacacatgtactacaatggaacggacagagagcagcgaacccgcgagggcaagcgaacctcaaaaaccgtttcccagttcggattgcaggctgcaactcgcctgcatgaagtcggaatcgctagtaatcgcaggtcagcatactgcggtgaatacgttcccgggtcttgtacacaccgcccgtcacaccacggaagtcgttcacacccgaagccggcgcagccgtctaaggtggggaaggtgactggggtgaagtcgtaacaaggtagccgtatcggaaggtgcgg

SEQ ID NO: 1694 - DNA, 1484 bp, Selenomonas flueggei
  modified_base (77)..(77): a, c, t, g, unknown or other
  modified_base (77)..(77): a, c, t, g, unknown or other
  modified_base (82)..(82): a, c, t, g, unknown or other
  modified_base (82)..(82): a, c, t, g, unknown or other
  modified_base (89)..(90): a, c, t, g, unknown or other
  modified_base (89)..(90): a, c, t, g, unknown or other
  modified_base (216)..(216): a, c, t, g, unknown or other
  modified_base (216)..(216): a, c, t, g, unknown or other
  modified_base (218)..(218): a, c, t, g, unknown or other
  modified_base (218)..(218): a, c, t, g, unknown or other
  modified_base (574)..(574): a, c, t, g, unknown or other
  modified_base (574)..(574): a, c, t, g, unknown or other
  modified_base (593)..(593): a, c, t, g, unknown or other
  modified_base (593)..(593): a, c, t, g, unknown or other
  modified_base (602)..(602): a, c, t, g, unknown or other
  modified_base (602)..(602): a, c, t, g, unknown or other
  modified_base (657)..(657): a, c, t, g, unknown or other
  modified_base (657)..(657): a, c, t, g, unknown or other
  modified_base (731)..(731): a, c, t, g, unknown or other
  modified_base (731)..(731): a, c, t, g, unknown or other
  modified_base (781)..(781): a, c, t, g, unknown or other
  modified_base (781)..(781): a, c, t, g, unknown or other
  modified_base (821)..(821): a, c, t, g, unknown or other
  modified_base (821)..(821): a, c, t, g, unknown or other
  modified_base (946)..(946): a, c, t, g, unknown or other
  modified_base (946)..(946): a, c, t, g, unknown or other
  modified_base (948)..(948): a, c, t, g, unknown or other
  modified_base (948)..(948): a, c, t, g, unknown or other
  modified_base (1019)..(1019): a, c, t, g, unknown or other
  modified_base (1019)..(1019): a, c, t, g, unknown or other
  modified_base (1148)..(1148): a, c, t, g, unknown or other
  modified_base (1148)..(1148): a, c, t, g, unknown or other
  modified_base (1158)..(1158): a, c, t, g, unknown or other
  modified_base (1158)..(1158): a, c, t, g, unknown or other
  modified_base (1305)..(1305): a, c, t, g, unknown or other
  modified_base (1305)..(1305): a, c, t, g, unknown or other
gagagtttgatcctggctcaggacgaacgctggcggcgtgcttaacacatgcaagtcgaacggagcgaatgaaagcntgcanttatganncttagtggcaaacgggtgagtaacacgtagacaacctgccgacaggatggggacaacattccgaaaggaatgctaataccgaatgaagcggaggagaggcatctctcttccgtgaaagatggccantntttatgctatcacctgttgatgggtctgcgtctgattagctggtaggtgaggtaacggctcacctaggcgacgatcagtagccggtctgagaggatgaacggccacattgggactgagacacggcctagactcctacgggaggcagcagtggggaatcttccgcaatgggcgcaagcctgacggagcaacgccgcgtgagtgaagaaggtcttcggatcgtaaagctctgttgttcgggacgaacgtgcgtgatgcgaacagtgtcatgcaatgacggtacctgtcgaggaagccacggctaactacgtgccagcagccgcggtaatacgtaggtggctagcgttgtccggaatcnttgggcgtaaagggagcgnaggcgggcnagtaagtctttcttaaaagtgcggggctcaaccccgtgatgggaaagaaactacntgtcttgagtacgggagaggaaagcggaattcccagtgtagcggtgaaatgcgtagatattgggaggaacgccngtggcgaaggcggctttctggactgcgactgacgctgaggctcgaaagcnaggggagcgaacgggattagataccccggtagtcctggcngtaaacgatggatactaggtgtgggaggtatcgacccctaccgtgccggagttaacgcaataagtatcccgcctggggagtacggccgcaaggctgaaactcaaaggaattgacggggacccgcncnagcggtggagtatgtggtttaattcgaagcaacgcgaacaaccttaccaggccttgacattgactgaaagngctagagatagctccctctcttcggagacaggaaaacaggtggtgcatggctgtcgtcagctcgtgtcgtgagatgttgggttaagtcccgcaacgagcgcaacccctgtcctttgttgccatcacgtnaaggtgggcnctcaaaggagactgccgcggagaacgcggaggaaggcggggatgacgtcaagtcatcatgccccttatgctctgggctacacacgtactacaatggaacggacagagagcagcgaacccgcgagggcaagcgaacctcaaaaaccgnttcccagttcggattgcaggctgcaacccgcctgcatgaagtcggaatcgctagtaatcgcaggtcagcatactgcggtgaatacgttcccgggtcttgtacacaccgcccgtcacaccacggaagtcattcacacccgaagccggctargccgtctaaggtggggaaggtgactgggg

SEQ ID NO: 1695 - DNA, 1296 bp, Selenomonas sp.
  C1
gacgaacgctggcggcgtgcttaacacatgcaagtcgaacgagtggcaaacgggtgagtaacgcgtagacaacctgccgcaaagatggggacaacagcccgaaagggctgctaataccgaatgttcaaagtcgctttgcgatgggtctgcgcctgattagctggttggcggggcaacggcccgccaaggcgacgatcagtagccggtctgagaggatggacggccacattgggactgagacacggcccagactcctacgggaggcagcagtggggaatcttccgcaatgggcgaaagcctgacggagcaacgccgcgtgggtgaagaaggtcttcggatcgtaaagccctgttgcccgggacgatgacggtaccgggcgaggaagccacggccaactacgtgccagcagccgcggtaatacgtaggtggcgagcgttgtccggaatcattgggcgtaaagggagcgcaggcgggcatgcaagtccatcttaaaagcgcggggcccaaccccgtgaggggatggaaactgcgtgccttgagtgcaggagaggaaagcggaattcccagtgtagcggtgaaatgcgtagatattgggaggaacaccagtggcgaaggcggctttctggactgactgacgctgaggctcgaaagccaggggagcgaacgggattagataccccggtagtcctggccgtaaacgatgaatgctaggtgtgggggctcccgtgccggagtcaacgcaataagcattccgcctggggagtacggccgcaaggctgaaactcaaaggaattgacgggggcccgcacaagcggtggagtatgtggttcaattcgacgcaacgcgaagaaccttaccagggcttgacattaacaggtggtgcatggctgtcgtcagctcgtgtcgtgagatgttgggtcaagtcccgcaacgagcgcaacccctgtccctcgttgccagcgcgcggggactcaagggagactgccgcggacaacgcggaggaaggcggggacgacgtcaagtcatcatgccccttatgccctgggctacacacgtactacaatgggatgcagagggcagcgagcccgcgagggcgagcgaaccccggcatcccccagttcggatgcaggctgaaacccgcctgcagaagttggaatcgctagtaatcgcaggtcagcatactgcggtgaatacgttcccgggccttgtacacaccgcccgtcacaccacggaagtcattcacacccgaagccggcacgcagcaagccgcccaaggtgggggcgatgactggggtg

SEQ ID NO: 1696 - DNA, 1319 bp, Selenomonas sp.
  C2
gacgaacgctggcggcgtgcttaacacatgcaagtcgaacgagtggcaaacgggtgagtaacgcgtaggcaacctgccctcaggatggggacaacggctcgaaagagccgctaataccgaatgactaaagtcgcctaaggatgggcctgcgtctgattagccagttggtgaggtaacggctcaccaaagcgacgatcagtagccggtctgagaggatgaacggccacaatgggactgagacacggcccatactcctacgggaggcagcagtggggaatcttccgcaatgggcgaaagcctgacggagcaacgccgcgtgagtgaagaaggtcttcggatcgtaaagctctgttgtcggggacgaagacggtacctgacgaggaagccacggctaactacgtgccagcagccgcggtaatacgtaggcggcaagcgttgtccggaattattgggcgtaaagggagcgcaggtgggacggtaagtccgtcttaaaaggcaggggctcagcccctgtaagggatggaaactatcgatcttgagtgccggagaggaaagcggaattcccagtgtagcggtgaaatgcgtagatattgggaagaacaccagtggcgaaggcggctttctggacggactgacactgaggctcgaaagccaggggagcgaacgggattagataccccggtagtcctggccgtaaacgatggatactaggtgtaggagctcctgtgccggagttaacgcaataagtatcccgcctggggggtacggtcgcaagactgaaactcaaaggaattgacgggggcccgcacaagcggtggagtatgtggtttaattcgacgcaacgcgaagaaccttaccagggcttgacattaacaggtggtgtatggctgtcgtcagctcgtgtcgtgagatgttgggttaagtcccgcaacgagcgcaacccctatattctgttgccaacagctgggaactcaggatagactgccgcggagaacgcggaggaaggcggggatgacgtcaagtcatcatgccccatatgacctgggctacacacgtactacaatgggatgcagagggcagcgaaagagcgatctggagcgaaccccagcatctcccagttcggatgcaggctgaaacccgcctgcagaagatggaatcgctagtaatcgcaggtcagcatactgcggtgaatacgttcccgggccttgtacacaccgcccgtcacaccacggaagtcattcacacccgaagccggaccgtcgaaggtgggggcgatgactggggtgaagtcgtaacaaggtagccgtatcggaaggtgc

SEQ ID NO: 1697 - DNA, 1329 bp, Selenomonas sp.
  P5
gacgaacgctggcggcgtgcttaacacatgcaagtcgaacgagtggcaaacgggtgagtaacacgtaggcaacctgccgacaggatggggacaacattccgaaaggaatgctaataccgaatgaagaaagtcacctgtcgatgggcctgcgtctgattagccagttggcggggtaacggcccaccaaagcgacgatcagtagccggtctgagaggatgaacggccacattgggactgagacacggcccagactcctacgggaggcagcagtggggaatcttccacaatgggcgaaagcctgatggagcaacgccgcgtgagtgaagaaggtcttcggatcgtaaagctctgttgtacgggacgatgacggtaccgtacgaggaagccacggctaactacgtgccagcagccgcggtaatacgtaggtggcgagcgttgtccggaattattgggcgtaaagggagcgcaggcggacatataagtccatcttaaaagtgcggggctcaaccccgtgaggggatggaaactgtatgccttgagtgcaggagaggaaagcggaattcccagtgtagcggtgaaatgcgtagatattgggaggaacaccagtggcgaaggcggctttctggactgactgacgctgaggctcgaaagccaggggagcgaacgggattagataccccggtagtcctggccgtaaacgatgaatgctaggtgtaggagctcctgtgccggagttaacgcaataagcattccgcctggggagtacggtcgcaagactgaaactcaaaggaattgacgggggcccgcacaagcggtggagtatgtggtttaattcgacgcaacgcgaagaaccttaccagggcttgacattaacaggtggtgcatggctgtcgtcagctcgtgtcgtgagatgttgggttaagtcccgcaacgagcgcaacccctgtcccttgttgccagcacgtgggaactcaagggagactgccgtggagaacgcggaggaaggcggggatgacgtcaagtcatcatgccccttatgtcctgggctacacacgtactacaatgggatgcagagggaagcgagggcgcgagccggagcggatcccagcatcccccagttcggatgcaggctgcaacccgcctgcagaagtcggaatcgctagtaatcgcaggtcagcatactgcggtgaatacgttcccgggccttgtacacaccgcccgtcacaccacggaagtcattcacgcccgaagccggcggccaggcagccgtctaaggcgggggcgatgactggggtgaagtcgtaacaaggtagccgtatcggaaggtgc

SEQ ID NO: 1698 - DNA, 1287 bp, Selenomonas sp.
  P6 oral clone MB3_C41
gacgaacgctggcggcgtgcttaacacatgcaagtcaaacgagtggcaaacgggtgagtaacgcgtaggcaacctgcccttaggatggggacaacggcccgaaaggaccgctaataccgaatgactaaagtcgccgaaggaagggcctgcgtctgattagccagttggtgaggtaacggctcaccaaagcaacgatcagtagccggtctgagaggatgaacggccacaatgggactgagacacggcccatactcctacgggaggcagcagtggggaatcttccgcaatgggcgcaagcctgacggagcaacgccgcgtgagtgaagaaggtcttcggatcgtaaaactctgttgacggggacgatgacggtacctgtcgaggaagccacggctaactacgtgccagcagccgcggtaatacgtaggtggcgagcgttgtccggaatcattgggcgtaaagggagcgcaggcgggcatgtaagtctttcttaaaagttcggggctcaaccccgtgatgggaaagaaactacatgtcttgagtacaggagaggaaagcggaattcccagtgtagcggtgaaatgcgtagatattgggaggaacaccagtggcgaaggcggctttctggactgactgacgctgaggctcgaaagccaggggagcgaacgggattagataccccggtagtcctggccgtaaacgatggatactaggtgtgggagctaccgtgtcggagttaacgcaataagtatcccgcctggggagtacggtcgcaagactgaaactcaaaggaattgacggggacccgcacaagcggtggagtatgtggtttaattcggagcaacgcgaagaaccttaccaggccttgacattaacaggtggtgcatggctgtcgtcagctcgtgtcatgagatgttgggttaagtcccgcaacgagcgcaacccctgttctttgttgccatcacgtgggcactcaaaggagactgccgcggagaacgcggaggaaggcggggatgacgtcaagtcatcatgccccttatggtctgggctacacacgtactacaatggaacgcagagagcagcgaacccgcgagggcaagcgaacctcaacgtttcccagttcggatgcaggctgcaactcgcctgcagaagtcggaatcgctagtaatcgcaggtcagcatactgcggtgaatacgttcccgggtcttgtacacaccgcccgtcacaccacggaagtcgttcacacccgaagccggcgccgtctaaggtggggaaggtgactggggtg

SEQ ID NO: 1699 - DNA, 1460 bp, Selenomonas sp.
  P7 oral clone MB5_C08
gacgaacgctggcggcgtgcttaacacatgcaagtcgaacgggaacctttatttcggtaaaggtgagagtggcaaacgggtgagtaacacgtaggcaacctgccgacaggatggggacaacattccgaaaggaatgctaataccgaatggagtccggggatggcatcatccctggataaaagatggcctctgaatatgctatcgcctgtcgatgggcctgcgtctgattagccagttggcggggtaacggcccaccaaagcgacgatcagtagccggtctgagaggatgaacggccacattgggactgagacacggcccagactcctacgggaggcagcagtggggaatcttccacaatgggcgaaagcctgacggagcaacgccgcgtgagtgaagaaggtcttcggatcgtaaagctctgttgacggggacgaacgtgcaaagggtgaataatcctttgcaatgacggtacctgtcgaggaagccacggctaactacgtgccagcagccgcggtaatacgtaggtggcgagcgttgtccggaatcattgggcgtaaagggagcgcaggcgggcatgtaagtctttcttaaaagttcggggctcaaccccgtgatgggaaagaaactatgtgtcttgagtacaggagaggaaagcggaattcccagtgtagcggtgaaatgcgtagatattgggaggaacaccagtggcgaaggcggctttctggactgcaactgacgctgaggctcgaaagccaggggagcgaacgggattagataccccggtagtcctggccgtaaacgatggatactaggtgtgggaggtatcgacccctaccgtgccggagttaacgcaataagtatcccgcctgggaagtacgatcgcaagattaaaactcaaaggaattgacgggggcccgcacaagcggtggagtatgtggtttaattcgacgcaacgcgaagaaccttaccagggcttgacattgagtgacagacttagagacaagtcattctcttcggagacacgaaaacaggtggtgcatggctgtcgtcagctcgtgtcgtgagatgttgggttaagtcccgcaacgagcgcaacccctgttctttgttgccatcacgtaaaggtgggcactcaaaggagactgccgcggagaacgcggaggaaggcggggatgacgtcaagtcatcatgccccttatggtctgggctacacacgtactacaatggaacggacagagagcagcgaacccgcgagggcaagcgaacctcaaaaaccgtttcccagttcggattgcaggctgcaactcgcctgcatgaagtcggaatcgctagtaatcgcaggtcagcatactgcggtgaatacgttcccgggtcttgtacacaccgcccgtcacaccacggaagtcgttcacacccgaagccggcggagccgtctaaggtggggaaggtgactggggtg

SEQ ID NO: 1700 - DNA, 1296 bp, Selenomonas sp.
  P8 oral clone MB5_P06
gacgaacgctggcggcgtgcttaacacatgcaagtcgaacgagtggcaaacgggtgagtaacgcgtagacaacctgccgcaaagatggggacaacagttcgaaaggactgctaataccgaatgttcaaagtcgctttgcgatgggtctgcgtctgattagctagttggcagggcaacggcctaccaaggcgacgatcagtagccggtctgagaggatgaacggccacattgggactgagacacggcccagactcctacgggaggcagcagtggggaatcttccgcaatgggcgaaagcctgacggagcaacgccgcgtgagtgaagaaggtcttcggatcgtaaagctctgttgccggggacgatgacggtacccggcgaggaagccacggctaactacgtgccagcagccgcggtaatacgtaggtggcgagcgttgtccggaattattgggcgtaaagggagcgcaggcgggcgagtaagtctttcttaaaagtgcggggctcaaccccgtgaggggagagaaactactcatcttgagtgcaggagaggaaagcggaattcctagtgtagcggtgaaatgcgtagatattaggaagaacaccagtggcgaaggcggctttctggactgactgacgctgaggctcgaaagccaggggagcgaacgggattagataccccggtagtcctggccgtaaacgatgaatgctaggtgtaggggctcctgtgccggagttaacgcaataagcattccgcctggggagtacggtcgcaagactgaaactcaaaggaattgacgggggcccgcacaagcggtggagtatgtggtttaattcgacgcaacgcgaagaaccttaccagggcttgacattaacaggtggtgcatggctgtcgtcagctcgtgtcgtgagatgttgggttaagtcccgcaacgagcgcaacccctattctctgttgccagcacgtgggaactcagaggagactgccgcggacaacgcggaggaaggcggggatgacgtcaagtcatcatgccccttatgtcctgggctacacacgtactacaatgggatgcggagagcagcgaagccgcgaggccaagcgaaccccaacatttcccagttcggatgcaggctgcaactcgcctgcagaagatggaatcgctagtaatcgcaggtcagcatactgcggtgaatacgttcccgggccttgtacacaccgcccgtcacaccacggaagtcgttcacacccgaagccggtgggcagctagctgtctaaggcgggggcgatgactggggtg

SEQ ID NO: 1701 - DNA, 1519 bp, Selenomonas infelix
ggagagtttgatcctggctcaggacgaacgctggcggcgtgcttaacacatgcaagtcgaacggagcgaatgaaagcttgcttttatgagcttagtggcaaacgggtgagtaacacgtagacaacctgccgacaggatggggacaacattccgaaaggaatgctaataccgaatgaagcggaggagaggcatctctcctccgtgaaagatggcctctgtatatgctatcacctgtcgatgggtctgcgtctgattagctagttggtgaggtaacggctcaccaaggcgacgatcagtagccggtctgagaggatgaacggccacattgggactgagacacggcccagactcctacgggaggcagcagtggggaatcttccgcaatgggcgcaagcctgacggagcaacgccgcgtgagtgaagaaggtcttcggatcgtaaagctctgttgatggggacgaacgtgcgaagggtgaataatcctttgcaatgacggtacctatcgaggaagccacggctaactacgtgccagcagccgcggtaatacgtaggtggcgagcgttgtccggaatcattgggcgtaaagggagcgcaggcgggcatgtaagtctttcttaaaagttcggggctcaaccccgtgatgggaaagaaactacatgtcttgagtacaggagaggaaagcggaattcccagtgtagcggtgaaatgcgtagatattgggaggaacaccagtggcgaaggcggctttctggactgcaactgacgctgaggctcgaaagccaggggagcgaacgggattagataccccggtagtcctggccgtaaacgatggatactaggtgtgggaggtatcgacccctaccgtgccggagttaacgcaataagtatcccgcctggggagtacggtcgcaagactgaaactcaaaggaattgacggggacccgcacaagcggtggagtatgtggtttaattcgaagcaacgcgaagaaccttaccaggccttgacattgactgtaagagctagagatagctccctctcttcggagacaggaaaacaggtggtgcatggctgtcgtcagctcgtgtcgtgagatgttgggttaagtcccgcaacgagcgcaacccctgttctttgttgccatcacgtaaaggtgggcactcaaaggagactgccgcggagaacgcggaggaaggcggggatgacgtcaagtcatcatgccccttatggtctgggctacacacgtactacaatggaacggacagagagcagcgaacccgcgagggcaagcgaacctcaaaaaccgtttcccagttcggattgcaggctgcaactcgcctgcatgaagtcggaatcgctagtaatcgcaggtcagcatactgcggtgaatacgttcccgggtcttgtacacaccgcccgtcacaccacggaagtcgttcacacccgaagccggcgcagccgtctaaggtggggaaggtgactggggtgaagtcgtaacaaggtagccgtatcggaaggtgc

SEQ ID NO: 1702 - DNA, 1520 bp, Selenomonas noxia
gagtttgatcctggctcaggacgaacgctggcggcgtgcttaacacatgcaagtcgaacggagcgaatgaaagcttgcttttataagcttagtggcaaacgggtgagtaacacgtaggcaacctgccgacaggatggggacaacattccgaaaggaatgctaataccgaatgaagtcagagaagggcatccttttctgatgaaagatggcctctatatataagctatcacctgtcgatgggcctgcgtctgattagctggtaggtgaggtaacggctcacctaggcgacgatcagtagccggtctgagaggatgaacggccacattgggactgagacacggcccagactcctacgggaggcagcagtggggaatcttccgcaatgggcgcaagcctgacggagcaacgccgcgtgagtgaagaaggtcttcggatcgtaaagctctgttgatggggacgaacgtgcctaatgcgaatagttttaggtaatgacggtacccatcgaggaagccacggctaactacgtgccagcagccgcggtaatacgtaggtggctagcgttgtccggaatcattgggcgtaaagggagcgcaggcgggcatgtaagtctttcttaaaagtgcggggctcaaccccgtgatgggaaagaaactatgtgtcttgagtacaggagaggaaagcggaattcccagtgtagcggtgaaatgcgtagatattgggaggaacaccagtggcgaaggcggctttctggactgcaactgacgctgaggctcgaaagccaggggagcgaacgggattagataccccggtagtcctggccgtaaacgatggatactaggtgtgggaggtatcgacccctaccgtgccggagttaacgcaataagtatcccgcctggggagtacggccgcaaggctgaaactcaaaggaattgacggggacccgcacaagcggtggagtatgtggtttaattcgaagcaacgcgaagaaccttaccaggccttgacattgactgaaagagctagagatagctccctctcttcggagacaggaaaacaggtggtgcatggctgtcgtcagctcgtgtcgtgagatgttgggttaagtcccgcaacgagcgcaacccctgttctttgttgccagcatgtaaggatgggcactcaaaggagactgccgcggagaacgcggaggaaggcggggatgacgtcaagtcatcatgccccttatggtctgggctacacacgtactacaatgggacggacagagggcagcgagagagtgatcttaagcgaatctcaaaaaccgtttctcagttcggattgcaggctgcaactcgcctgcatgaagtcggaatcgctagtaatcgcaggtcagcatactgcggtgaatacgttcccgggtcttgtacacaccgcccgtcacaccacggaagtcattcacacccgaagccggctaggccgtctaaggtggggaaggtgactggggtgaagtcgtaacaaggtagccgtatcggaaggtgcgg

SEQ ID NO: 1703 - DNA, 1565 bp, Selenomonas ruminantium
attttatggagagtttgatcctggctcaggacgaacgctggcggcgtgcttaacacatgcaagtcgaacgagacgattgaaagcttgcttttgagagtcgagtggcaaacgggtgagtaacgcgtagacaacctgccgcaaagatggggacaacagtccgaaaggactgctaataccgaatgttgtcagattcccgcatgggagactgattaaagatggcctctacttgtaagctatcgctttgcgatgggtctgcgtctgattagctagttggtggggtaacggcctaccaaggcgacgatcagtagccggtctgagaggatgaacggccacattggaactgagacacggtccagactcctacgggaggcagcagtggggaatcttccgcaatgggcgaaagcctgacggagcaacgccgcgtgagtgaagaagggtttcggctcgtaaagctctgttgacggggacgaatgtgcgaaatgcgaatagtttttcgcaatgacggtacccgtcgaggaagccacggctaactacgtgccagcagccgcggtaatacgtaggtggcgagcgttgtccggaattattgggcgtaaagggagcgcaggcgggaaggcaagtcagtcttaaaagtgcggggctcaaccccgtgatgggattgaaactgtctttcttgagtgcaggagaggaaagcggaattcctagtgtagcggtgaaatgcgtagatattaggaggaacaccagtggcgaaggcggctttctggactgtaactgacgctgaggctcgaaagcgtggggagcgaacaggattagataccctggtagtccacgccgtaaacgatgaatgctaggtgtaggaggtatcgaccccttctgtgccggagttaacgcaataagcattccgcctggggagtacggtcgcaagactgaaactcaaaggaattgacgggggcccgcacaagcggtggagtatgtggtttaattcgacgcaacgcgaagaaccttaccagggcttgacattgagtgaaagatctagagatagatccctctcttcggagacacgaaaacaggtggtgcatggctgtcgtcagctcgtgtcgtgagatgttgggttaagtcccgcaacgagcgcaacccctatcatttgttgccagcacgttatggtgggaactcaaatgagactgccgcggacaacgcggaggaaggcggggatgacgtcaagtcatcatgccccttatgtcctgggctacacacgtactacaatgggatggacagagagcagcgaacccgcgagggcaagcgaaccccataaaccatctcccagttcggattgcaggctgcaacccgcctgcatgaagtcggaatcgctagtaatcgctggtcagcatacagcggtgaatacgttcccgggccttgtacacaccgcccgtcacaccacggaagtcattcacacccgaagccggtgggcaaaccgcaaggatgcagccgtctaaggtgggggcgatgactggggtgaagtcgtaacaaggtagccgtatcggaaggtgcggctggatcacctcctttct

SEQ ID NO: 1704 - DNA, 1270 bp, Selenomonas sp.
  FOBRC9
  modified_base (1084)..(1084): a, c, t, g, unknown or other
  modified_base (1084)..(1084): a, c, t, g, unknown or other
  modified_base (1175)..(1175): a, c, t, g, unknown or other
  modified_base (1175)..(1175): a, c, t, g, unknown or other
ccctatatgaaagatggcctctatatataagctatcactgatcgatgggtctgcgtctgattagctagtaggtaaggtaacggcttacctaggcgacgatcagtagccggtctgagaggatgaacggccacattgggactgagacacggcccagactcctacgggaggcagcagtggggaatcttccgcaatgggcgcaagcctgacggagcaacgccgcgtgagtgaagaaggtcttcggatcgtaaagctctgttgaaggggacgaacgatcgaggggcgaacaggctctcggtatgacggtaccttttgaggaagccacggctaactacgtgccagcagccgcggtaatacgtaggtggcgagcgttgtccggaatcattgggcgtaaagggagcgcaggcggccatgtaagtcttgcttaaaagttcggggctcaaccccgtgatgggcaagaaactatatggcttgagtgcaggagaggaaagcggaattcccagtgtagcggtgaaatgcgtagatattgggaggaacaccagtggcgaaggcggctttctggactgcaactgacgctgaggctcgaaagccaggggagcgaacgggattagataccccggtagtcctggccgtaaacgatggatactaggtgtgggaggtatcgacccctaccgtgccggagttaacgcaataagtatcccgcctggggagtacggtcgcaagactgaaactcaaaggaattgacggggacccgcacaagcggtggagtatgtggtttaattcgaagcaacgcgaagaaccttaccaggtcttgacattgattgacagggatagagatatcctattctctttggagacaagaaaacaggtggtgcatggctgtcgtcagctcgtgtcgtgagatgttgggttaagtcccgcaacgagcgcaacccctgtcctttgttgccagcatgtagtggtgggcactcaaaggagactgccgcggagaacgcggaggaaggcggggatgacgtcaagtcatcatgccccttatgacctgggctacacacgtactacaatgggacggacagagagcagcgagagngcgaccttaagcgaacctcaaaaaccgtttctcagttcggattgcaggctgcaactcgcctgcatgaagtcggaatcgctagtaatcgcangtcagcatactgcggtgaatacgttcccgggtcttgtacacaccgcccgtcacaccacggaagtcgttcacacccgaagccggcgcagccgtcta

SEQ ID NO: 1705 - DNA, 1356 bp, Selenomonas sp.
  oral clone FT050
gagtttgatcctggctcaggacgaacgctggcggcgtgcttaacacatgcaagtcgaacgagtggcaaacgggtgagtaacacgtagacaacctgccgacaggatggggacaacattccgaaaggaatgctaataccgaatgaagaaagtcacctgttgatgggtctgcgtctgattagctagttggtgaggtaacggctcaccaaggcgacgatcagtagccggtctgagaggatgaacggccacattgggactgagacacggcccagactcctacgggaggcagcagtggggaatcttccgcaatgggcgcaagcctgacggagcaacgccgcgtgagtgaagaaggtcttcggatcgtaaagctctgttgacggggacgatgacggtacctgtcgaggaagccacggctaactacgtgccagcagccgcggtaatacgtaggtggcgagcgttgtccggaatcattgggcgtaaagggagcgcaggcgggccggtaagtcttacttaaaagtgcggggctcaaccccgtgatgggagagaaactatcggtcttgagtacaggagaggaaagcggaattcccagtgtagcggtgaaatgcgtagatattgggaagaacaccagtggcgaaggtggctttctggactgactgacgctgaggctcgaaagccaggggagcgaacgggattagataccccggtagtcctggccgtaaacgatggatactaggtgtgggagctaccgtgccggagttaacgcaataagtatcccgcctggggagtacggccgcaaggctgaaactcaaaggaattgacggggacccgcacaagcggtggagtatgtggtttaattcgaagcaacgcgaagaaccttaccaggccttgacattaacaggtggtgcatggctgtcgtcagctcgtgtcgtgagatgttgggttaagtcccgcaacgagcgcaacccctgttctttgttgccatcagctgggcactcaaaggagactgccgcggagaacgcggaggaaggcggggatgacgtcaagtcatcatgccccttatggcctgggctacacacgtactacaatggaacgcagagagcagcgaacccgcgagggcaagcgaacctcaacgtttcccagttcggatgcaggctgcaacccgcctgcagaagtcggaatcgctagtaatcgcaggtcagcatactgcggtgaatacgttcccgggtcttgtacacaccgcccgtcacaccacggaagtcattcacacccgaagccggcgccgtctaaggtggggaaggtgactggggtgaagtcgtaacaaggtagccgtatcggaaggtgcggctggaacacctcctt

SEQ ID NO: 1706 - DNA, 1356 bp, Selenomonas sp.
  oral clone GI064
gagtttgattctggctcaggacgaacgctggcggcgtgcttaacacatgcaagtcgaacgagtggcaaacgggtgagtaacacgtagacaacctgccgacaggatggggacaacattccgaaaggaatgctaataccgaatgaagaaagtcacctgttgatgggtctgcgtctgattagctagttggtgaggtaacggctcaccaaggcgacgatcagtagccggtctgagaggatgaacggccacattgggactgagacacggcccagactcctacgggaggcagcagtggggaatcttccgcaatgggcgcaagcctgacggagcaacgccgcgtgagtgaagaaggtcttcggatcgtaaagctctgttgacggggacgatgacggtacctgtcgaggaagccacggctaactacgtgccagcagccgcggtaatacgtaggtggcgagcgttgtccggaatcattgggcgtaaagggagcgcaggcgggccggtaagtcttacttaaaagtgcggggctcaaccccgtgatgggagagaaactatcggtcttgagtacaggagaggaaagcggaattcccagtgtagcggtgaaatgcgtagatattgggaagaacaccagtggcgaaggcggctttctggactgactgacgctgaggctcgaaagccaggggagcgaacgggattagataccccggtagtcctggccgtaaacgatggatactaggtgtgggagctaccgtgccggagttaacgcaataagtatcccgcctggggagtacggccgcaaggctgaaactcaaaggaattgacggggacccgcacaagcggtggagtatgtggtttaattcgaagcaacgcgaagaaccttaccaggccttgacattaacaggtggtgcatggctgtcgtcagctcgtgtcgtgagatgttgggttaagtcccgcaacgagcgcaacccctgttctttgttgccatcagctgggcactcaaaggagactgccgcggagaacgcggaggaaggcggggatgacgtcaagtcatcatgccccttatggcctgggctacacacgtactacaatggaacgcagagagcagcgaacccgcgagggcaagcgaacctcaacgtttcccagttcgggtgcaggctgcaacccgcctgcagaagtcggaatcgctagtaatcgcaggtcagcatactgcggtgaatacgttcccgggtcttgtacacaccgcccgtcacaccacggaagtcattcacacccgaagccggcgccgtctaaggtggggaaggtgactggggtgaagtcgtaacaaggtagccgtatcggaaggtgcggctggatcacctcctt

SEQ ID NO: 1707 - DNA, 1356 bp, Selenomonas sp.
  oral clone GT010
gagtttgattctggctcaggacgaacgctggcggcgtgcttaacacatgcaagtcgaacgagtggcaaacgggtgagtaacacgtaggcaacctgccgacaggatggggacaacattccgaaaggaatgctaataccgaatgaagaaagtcacctgtcgatgggcctgcgtctgattagctagttggtgaggtaacggctcaccaaggcgacgatcagtagccggtctgagaggatgaacggccacattgggactgagacacggcccagactcctacgggaggcagcagtggggaatcttccgcaatgggcgcaagcctgacggagcaacgccgcgtgagtgaagaaggtcttcggatcgtaaagctctgttgatggggacgatgacggtacctatcgaggaagccacggctaactacgtgccagcagccgcggtaatacgtaggtggcgagcgttgtccggaatcattgggcgtaaagggagcgcaggcgggcatgtaagtctttcttaaaagttcggggctcaaccccgtgatgggaaagaaactacatgtcttgagtacaggagaggaaagcggaattcccagtgtagcggtgaaatgcgtagatattgggaggaacaccagtggcgaaggcggctttctggactgactgacgctgaggctcgaaagccaggggagcgaacgggattagataccccggtagtcctggccgtaaacgatggatactaggtgtgggagctaccgtgccggagttaacgcaataagtatcccgcctggggagtacggtcgcaagactgaaactcaaaggaattgacggggacccgcacaagcggtggagtatgtggtttaattcgaagcaacgcgaagaaccttaccaggccttgacattaacaggtggtgcatggctgtcgtcagctcgtgtcgtgagatgttgggttaagtcccgcaacgagcgcaacccctgttctttgttgccatcacgtgggcactcaaaggagactgccgcggagaacgcggaggaaggcggggatgacgtcaagtcatcatgccccttatggtctgggctacacacgtactacaatggaacgcagagagcagcgaacccgcgagggcaagcgaacctcaacgtttcccagttcggatgcaggctgcaactcgcctgcagaagtcggaatcgctagtaatcgcaggtcagcatactgcggtgaatacgttcccgggtcttgtacacaccgcccgtcacaccacggaagtcgttcacacccgaagccggcgccgtctaaggtggggaaggcgactggggtgaagtcgtaacaaggtagccgtatcggaaggtgcggctggaacacctcctt

SEQ ID NO: 1708 - DNA, 1536 bp, Selenomonas sp.
  oral clone HU051
gagtttgatcctggctcaggacgaacgctggcggcgtgcttaacacatgcaagtcgaacggagctatttatttcggtagatagcttagtggcaaacgggtgagtaacacgtagacaacctgccgatcagatggggacaacattccgaaaggaatgctaataccgaatgaggtgtaggggaggcatctcccctacatgaaagatggcctctatatataagctatcactgatcgatgggtctgcgtctgattagctagtaggtaaggtaacggcttacctaggcgacgatcagtagccggtctgagaggatgaacggccacattgggactgagacacggcccagactcctacgggaggcagcagtggggaatcttccgcaatgggcgcaagcctgacggagcaacgccgcgtgagtgaagaaggtcttcggatcgtaaagctctgttgaaggggacgaacgtgcataggatgaataagcctgtgtaatgacggtaccttttgaggaagccacggctaactacgtgccagcagccgcggtaatacgtatgtggcgagcgttgtccggaatcattgggcgtaaagggagcgcaggcggtcatgtaagtcttacttaaaagttcggggctcaaccccgtgatgggtaagaaactatatgacttgagtacaggagaggaaagcggaattcccagtgtagcggtgaaatgcgtatgatattgggaggaacaccagtggcgaaggcggctttctggactgcaactgacactgaggctcgaaagccaggggagcgaacgggattagataccccggtagtcctggccgtacacgatggatactaggtgtaggaggtatcgacccctcctgtgccggagttaacgcaataagtatcccgcctggggagtacggtcgcaagactgaaactcagaggaattgacgggggcccgcacaagcggtggagtatgtggtttaattcgacgcaacgcgaagaaccttaccagggcttgacattgagtgaaagggcaagagattgtccccttatcttcggataacacgaaaacaggtggtgcatggctgtcgtcagctcgtgtcgtgagatgttgggttaagtcccgcaacgagcgcaacccctatattctgttgccaacaggtaaagctgggaactcaggatagactgccgcggagaacgcggaggaaggcggggatgacgtcaagtcatcatgccccatatgacctgggctacacacgtactacaatgggatgtacagagggcagcgaaagagcgatctggagcgaaccccagaaaacatctcccagttcggattgcaggctgaaacccgcctgcatgaagatggaatcgctagtaatcgcaggtcagcatactgcggtgaatacgttcccgggccttgtacacaccagcccgtcacaccacggaagtcattcacacccgaagccggtgaaagccgtcgaaggtgggggcgatgactggggtgaagtcgtaacaaggtagccgtatcggaaggtgcggctggaacacctcctt

SEQ ID NO: 1709 - DNA, 1356 bp, Selenomonas sp.
  oral clone IK004
gagtttgattctggctcaggacgaacgctggcggcgtgcttaacacatgcaagtcgaacgagtggcaaacgggtgagtaacacgtagacaacctgccgacaggatggggacaacattccgaaaggaatgctaataccgaatgaagaaagtcacctgccgatgggtctgcgtctgattagctagttggtgaggtaacggctcaccaaggcgacgatcagtagccggtctgagaggatgaacggccacattgggactgagacacggcccagactcctacgggaggcagcagtggggaatcttccgcaatgggcgcaagcctgacggagcaacgccgcgtgagtgaagaaggtcttcggatcgtaaagctctgttgatggggacgatgacggtacctatcgaggaagccacggctaactacgtgccagcagccgcggtaatacgtaggtggcgagcgttgtccggaatcattgggcgtaaagggagcgcaggcgggcatgtaagtctttcttaaaagttcggggctcaaccccgtgatgggaaagaaactacatgtcttgagtacaggagaggaaagcggaattcccagtgtagcggtgaaatgcgtagatattgggaggaacaccagtggcgaaggcggctttctggactgactgacgctgaggctcgaaagccaggggagcgaacgggattagataccccggtagtcctggccgtaaacgatggatactaggtgtgggagctaccgtgccggagttaacgcaataagtatcccgcctggggagtacggtcgcaagactgaaactcaaaggaattgacggggacccgcacaagcggtggagtatgtggtttaattcgaagcaacgcgaagaaccttaccaggccttgacattaacaggtggtgcatggctgtcgtcagctcgtgtcgtgagatgttgggttaagtcccgcaacgagcgcaacccctgttctttgttgccatcagctgggcactcaaaggagactgccgcggagaacgcggaggaaggcggggatgacgtcaagtcatcatgccccttatggtctgggctacacacgtactacaatggaacgcagagagcagcgaacccgcgagggcaagcgaacctcaacgtttcccagttcggatgcaggctgcaactcgcctgcagaagtcggaatcgctagtaatcgcaggtcagcatactgcggtgaatacgttcccgggtcttgtacacaccgcccgtcacaccacggaagtcgttcacacccgaagccggcgccgtctaaggtggggaaggtgactggggtgaagtcgtaacaaggtagccgtatcggaaggtgcggctggatcacctcctt

SEQ ID NO: 1710 - DNA, 1362 bp, Selenomonas sp.
  oral clone IQ048
agtttgattctggctcaggacgaacgcgggcggcgtgcttaacacatgcaagtcgaacgagtggcaaacgggtgagtaacacgtaggcaacctgccgacaggatggggacaacattccgaaaggaatgctaataccgaatgaagaaagtcacctgtcgatgggcctgcgtctgattagccagttggcggggtaacggcccaccaaagcgacgatcagtagccggtctgagaggatgaacggccacattgggactgagacacggcccagactcctacgggaggcagcagtggggaatcttccacaatgggcgaaagcctgatggagcaacgccgcgtgagtgaagaaggtcttcggatcgtaaagctctgttgcacgggacgaggacggaccgagcgaggaatccacggctaactacgtgccagcggccgcggtaatacgtacgtggcgagcgttgtccggaattattgggcgtaaagggagcgcagggggacatataagtccatcttaaaagtgcggtgctcaaccccgtgaggggatggaaactgtatgccttgagtgcaagataggaaagcggaattcccagtgtagcggtgaaatgcgtaatattgggaggaacaccagtggccaatgcggctttctggactgactgacgctgaggctcgaaagccaggggagcgaacgggattagataccccggtagtcctggccgtaaacgatgaatgctaggtgtaggagctcctgtgccggagttaacgcaataagcattccgcctggggagtacggtcgcaagactgaaactcaaaggaattgacgggggcccgcacaagcggtggagtatgtggtttaattcgaagcaacgcgaagaaccttaccaggccttgacattaacaggtggtgcatggctgtcgtcagctcgtgtcgtgagatgttgggttaagtcccgcaacgagcgcaacccctgttctttgttgccagcatatgggcactcaaaggagactgccgcggagaacgcggaggaaggcggggatgacgtcaagtcatcatgccccttatggtctgggctacacacgtactacaatgggacgcagagggcagcgagagagtgatcttaagcgaatctcaacgtttctcagttcggatgcaggctgcaactcgcctgcagaagtcggaatcgctagtaatcgcaggtcagcatactgcggtgaatacgttcccgggtcttgtacacaccgcccatcacaccacggaagtcattcacacccgaagccggcacgcagcaagccgcccaaggtgggggcgatgactggggtgaagtcgtaacaaggtagccgtatcggaaggtgcggctggatcacctcctt

SEQ ID NO: 1711 - DNA, 1366 bp, Selenomonas sp.
  oral clone JI021
ggagtttgattctggctcaggacgaacgctggcggcgtgcttaacacatgcaagtcgaacgagtggcaaacgggtgagtaacacgtaggcaacctgccgacaggatggggacaacattccgaaagggatgctaataccgaatggagaaagtcgcctgtcgatgggcctgcgtctgattagctagttggtgaggtaaaggctcaccaaggcgacgatcagtagccggtctgagaggatgaacggccacattgggactgagacacggcccagactcctacgggaggcagcagtggggaatcttccgcaatgggcgaaagcctgacggagcaacgccgcgtgagtgaagaaggtcttcggatcgtaaagctctgttgtcgaggacgatgacggtacttgacgaggaagtcacggctaactacgtgccagcagccgcggtaatacgtaggtggcaagcgttgtccggaatcattgggcgtaaagggagcgcaggtgggaacttaggtctttcttaaaagtgcggggctcaaccccgtgatgggagagaaaccgagattcttgagtgcaggagaggaaagcggaattcccggtgtagcggtgaaatgcgtagatatcgggaggaacaccagtggcgaaggcggctttctggactgactgacactgaggctcgaaagccagggtagcgaacgggattagataccccggtagtcctggccgtaaacgatgaatgctaggtgtaggagcttctgtgccggagttaacgcaataagcattccgcctggggagtacggccgcaaggctgaaactcaaaggaattgacgggggcccgcacaagcggtggagtatgtggtttaattcgacgcaacgcgaagaaccttaccagggcttgacattaacaggtggtgcatggctgtcgtcagctcgtgtcgtgagatgttgggttaagtcccgcaacgagcgcaacccctgtcctttgttgccagcgcgcgggaactcaaaggagactgccgcggagaacgcggaggaaggcggggatgacgtcaagtcatcatgccccttatgtcctgggctacacacgtactacaatgggatgcagagagcagcgaatgggcgaccatgagcgaaccccttcatctctcagttcggatgcaggctgaaacccgcctgcagaagtcggaatcgctagtaatcgcaggtcagcatactgcggtgaatacgttcccgggccttgtacacaccgcccgtcacaccacgaaagtcattcacacccgaagtcggtgaggacctagccgcctaaggtgggggcgatgattggggtgaagtcgtaacaaggtagccgtatcggaaggtgcggctggatcacctcctt

SEQ ID NO: 1712 - DNA, 1356 bp, Selenomonas sp.
  oral clone JS031
ggagtttgatcctggctcaggacgaacgctggcggcgtgcttaacacatgcaagtcgaacgagtggcaaacgggtgagtaacgcgtaggcaacctgccctcaggatggggacaacggctcgaaagagccgctaataccgaatgactaaagtcgcccgaggatgggcctgcgtctgattagccagttggtgaggtaacggctcaccaaagcaacgatcagtagccggtctgagaggatgaacggccacaatgggactgagacacggcccatactcctacgggaggcagcagtggggaatcttccgcaatgggcgaaagcctgacggagcaacgccgcgtgagtgaagaaggtcttcggatcgtaaagctctgttgtcggggacgaagacggtacccgacgaggaagccacggctaactacgtgccagcagccgcggtaatacgtaggcggcaagcgttgtccggaattattgggcgtaaagggagcgcaggtgggacggtaagtctgtcttaaaaggcaagggctcagcccctgtaagggacagaaactatcgttcttgagtgccggagaggaaagcggaattcccagtgtagcggtgaaatgcgtagatattgggaagaacaccagtggcgaaggcggctttctggacggactgacactgaggctcgaaagccagggtagcgaacgggattagataccccggtagtcctggccgtaaacgatggatactaggtgtaggggctcctgtgccggagttaacgcaataggtatcccgcctggggagtacggtcgcaagactgaaactcaaaggaattgacgggggcccgcacaagcggtggagtatgtggtttaattcgacgcaacgcgaagaaccttaccagggcttgacattaacaggtggtgcatggctgtcgtcagctcgtgtcgtgagatgttgggttaagtcccgcaacgagcgcaacccctatattctgttgccaacagctgggaactcaggatagactgccgcggagaacgcggaggaaggcggggatgacgtcaagtcatcatgccccttatgacctgggctacacacgtactacaatgggatgcagagggcagcgaaggagcgatctggagcgaaccccagcatctctcagttcggatgcaggctgaaacccgcctgcagaaggtggaatcgctagtaatcgcaggtcagcatactgcggtgaatacgttcccgggccttgtacacaccgcccgtcacaccacggaagtcattcacacccgaagccggaccgtcgaaggtgggggcgatgactggggtgaagtcgtaacaaggtagccgtatcggaaggtgcggctggatcacctcctt

SEQ ID NO: 1713 - DNA, 1414 bp, Selenomonas sp.
  oral clone OH4A
tacggagcgatgaagcttgcttttataagcttatggcaacgggtgagtaacaggtggacaacctgccgacaggatggggacaacattccgaaaggaatgctaataccgaatgaacagaggagaggcatctctcctctgtgaaagatggcctctttttatgctatcacctgttgatggggctgctctgattagctggtaggtggagtaacggctcacctaggggagaatcagtagccggtctgagaggatgaacggccacattgggactgagacacggcccagactcctacgggaggcagcagtggggaatcttccgcaatgggcgcaagcctgacggagcaacgccgcgtgagtgaagaaggtcttcggatcgtaaagctctgttgatggggcgaaacgtgcctaatgcgaatagttttaggtaatgacggtacccatcgaggaagccacggctaactacgtgccagcagccgcggtaatacgtaggtggcgagcgttgtccggaatcattgggcgtaaagggagcgcaggcgggcatgtaagtctttcttaaaagtgcggggctcaaccccgtgatgggaaagaaactatgtgtcttgagtacaggagaggaaagcggaattcccagtgtagcggtgaaatgcgtagatattgggaggaacaccagtggcgaaggcggctttctggactgcaactgacgctgaggctcgaaagccaggggagcgaacgggattagataccccggtagtcctggccgtaaacgatggatactaggtgtgggaggtatcgacccctaccgtgccggagttaacgcaataagtatcccgcctggggagtacggccgcaaggctgaaactcaaaggaattgacggggacccgcacaagcggtggagtatgtggtttaattcgaagcaacgcgaagaaccttaccaggccttgacattgactgaaagagttagagataactccctctcttcggagacaggaaaacaggtggtgcatggctgtcgtcagctcgtgtcgtgagatgttgggttaagtcccacaacgagcgcaacccctgttctttgttgccagcaagtgaagttgggcactcaaaggagactgccgcggagaacgcggaggaaggcggggatgacgtcaagtcatcatgccccttatggtctgggctacacacgtactacaatgggacggacagagggcagcgagagagtgatattaagcgaatctcaaaaaccgtttttcagttcggattgcaggctgcaactcgcctgcatgaagtcggaatcgttagtaatcgcaggtcagcatactgcggtgaatacgttcccgggtcttgtacacaccgcccgtcacaccacggaagtcattcacacccgaagccggcaaagccgtctaaggtggggaaggtgac

SEQ ID NO: 1714 - DNA, 1319 bp, Selenomonas sp.
  oral clone P2PA_80 P4
gacgaacgctggcggcgtgcttaacacatgcaagtcgaacgagtggcaaacgggtgagtaacgcgtaggcaacctgcccttaggatggggacaacggcccgaaaggaccgctaataccgaatgcagaaagtcgccgaaggaagggcctgcgcctgattagccagttggtgaggtaacggctcaccaaagcgacgatcagtagccggtctgagaggatgaacggccacaatgggactgagacacggcccatactcctacgggaggcagcagtggggaatcttccgcaatgggcgaaagcctgacggagcaacgccgcgtgagtgaagaaggtcttcggatcgtaaagctctgttgttggggacgaagacggtacccgacgagcaagccacggctaactacgtgccagcagccgcggtaatacgtaggtggcgagcgttgtccgggatgattgggcgtaaagggagcgcaggtgggacggtaagtccttcttaaaagcgtggggctcagccccatgaagggaaggaaactatcgatcttgagtgccagagaggaaagcggaattcccagtgtagcggtgaaatgcgtagatattgggaagaacaccagtggcgaaggcggctttctggacggactgacgctgaggctcgaaagccaggggagcgaacgggattagataccccgctagtcctggccgtaaacgatggatactaggtgtaggagcttctgtgccggagttaacgcaataagtatcccgcctggggagtacggtcgcaagattgaaactcaaaggaattgacgggggcccgcacaagcggtggagtatgtggtttaattcgacgcaacgcgaagaaccttaccagggcttgacattaacaggtggtgcatggctgtcgtcagctcgtgtcgtgagatgttgggttaagtcccgcaacgagcgcaacccctatgttctgttgccagcgcgcgggcactcagaagagactgccgcggagaacgcggaggaaggcgggggtgacgtcaagtcatcatgccccttatgacctgggctacacacgtactacaatgggatgcagagggcagcgaacgggcgaccggaagcgaaccccagcatctcccagttcggatgcaggctgaaacccgcctgcagaagatggaatcgctagtaatcgcaggtcagcatactgcggtgaatacgttcccgggccttgtacacaccgcccgtcacaccacggaagtcattcacacccgaagccggaccgtcgaaggtgggggcgatgactggggtgaagtcgtaacaaggtagccgtatcggaaggtgc

SEQ ID NO: 1715 - DNA, 1541 bp, Selenomonas sp.
  oral taxon 137
ggagagtttgatcctggctcaggacgaacgctggcggcgtgcttaacacatgcaagtcgaacggagcgaatgaaagcttgcttttatgagcttagtggcaaacgggtgagtaacacgtagacaacctgccgatcagatggggacaacattccgaaaggaatgctaataccgaatggcgtgtggggaggcatcttccctacatgaaagatggcctctatttataagctatcactgatcgatgggtctgcgtctgattagctagtaggtaaggtaacggcttacctaggcgacgatcagtagccggtctgagaggatgaacggccacattgggactgagacacggcccagactcctacgggaggcagcagtggggaatcttccgcaatgggcgcaagcctgacggagcaacgccgcgtgagtgaagaaggtcttcggatcgtaaagctctgttgaagggggcgaacgtacgcagtgcgaatagtgctgagtaatgacggtaccttttgaggaagccacggctaactacgtgccagcagccgcggtaatacgtaggtggcgagcgttgtccggaatcattgggcgtaaagggagcgcaggcggccatgtaagtcttgcttaaaagttcggggctcaaccccgtgatgggcaagaaactatatggcttgagtgcaggagaggaaagcggaattcccagtgtagcggtgaaatgcgtagatattgggaggaacaccagtggcgaaggcggctttctggactgcaactgacgctgaggctcgaaagccaggggagcgaacgggattagataccccggtagtcctggccgtaaacgatggatactaggtgtgggaggtatcgacccctaccgtgccggagttaacgcaataagtatcccgcctggggagtacggtcgcaagactgaaactcaaaggaattgacggggacccgcacaagcggtggagtatgtggtttaattcgaagcaacgcgaagaaccttaccaggtcttgacattgattgacagggatagagatatcctattctctttggagacaagaaaacaggtggtgcatggctgtcgtcagctcgtgtcgtgagatgttgggttaagtcccgcaacgagcgcaacccctgtcctttgttgccagcatgtagtggtgggcactcaaaggagactgccgcggagaacgcggaggaaggcggggatgacgtcaagtcatcatgccccttatgacctgggctacacacgtactacaatgggacggacagagagcagcgagagggcgaccttaagcgaacctcaaaaaaccgtttctcagttcggattgcaggctgcaactcgcctgcatgaagtcggaatcgctagtaatcgcaggtcagcatactgcggtgaatacgttcccgggtcttgtacacaccgcccgtcacaccacggaagtcgttcacacccgaagccggcgcagccgtctaaggtggggaaggtgactggggtgaagtcgtaacaaggtagccgtatcggaaggtgcggctggatcacctcctttct

SEQ ID NO: 1716 - DNA, 1265 bp, Selenomonas sp.
  oral taxon 149
ggctcaccaaggcgacgatcagtagccggtctgagaggatgaacggccacattgggactgagacacggcccagactcctacgggaggcagcagtggggaatcttccgcaatgggcgcaagcctgacggagcaacgccgcgtgagtgaagaaggtcttcggatcgtaaagctctgttgacggggacgaacgtgcggagtgcgaatagcgctttgtaatgacggtacctgtcgaggaagccacggctaactacgtgccagcagccgcggtaatacgtaggtggcgagcgttgtccggaatcattgggcgtaaagggagcgcaggcgggccggtaagtcttacttaaaagtgcggggctcaaccccgtgatgggagagaaactatcggtcttgagtacaggagaggaaagcggaattcccagtgtagcggtgaaatgcgtagatattgggaagaacaccagtggcgaaggcggctttctggactgcaactgacgctgaggctcgaaagccaggggagcgaacgggattagataccccggtagtcctggccgtaaacgatggatactaggtgtgggaggtatcgacccctaccgtgccggagttaacgcaataagtatcccgcctggggagtacggccgcaaggctgaaactcaaaggaattgacggggacccgcacaagcggtggagtatgtggtttaattcgaagcaacgcgaagaaccttaccaggccttgacattgactgaaagagctagagatagcaccctctcttcggagacaggaaaacaggtggtgcatggctgtcgtcagctcgtgtcgtgagatgttgggttaagtcccgcaacgagcgcaacccctgttctttgttgccatcaggtaaagctgggcactcaaaggagactgccgcggagaacgcggaggaaggcggggatgacgtcaagtcatcatgccccttatggcctgggctacacacgtactacaatggaacggacagagagcagcgaacccgcgagggcaagcgaacctcaaaaaccgtttcccagttcggattgcaggctgcaacccgcctgcatgaagtcggaatcgctagtaatcgcaggtcagcatactgcggtgaatacgttcccgggtcttgtacacaccgcccgtcacaccacggaagtcattcacacccgaagccggcgcagccgtctaaggtggggaaggtgactggggtgaagtcgtaacaaggtagccgtatcggaaggtgcggctggatcacctcctttct

SEQ ID NO: 1717 - DNA, 1548 bp, Selenomonas sputigena
ggagagtttgatcctggctcaggacgaacgctggcggcgtgcttaacacatgcaagtcgaacgggaacctttatttcggtaaaggtgagagtggcaaacgggtgagtaacacgtaggcaacctgccgacaggatggggacaacattccgaggaatgctaataccgaatggagtccggggatggcatcatcctcggataagatggcctctgaatatgctatcgcctgtcgatgggcctgcgtctgattagccagttggcggggtaacggcccaccaaagcgacgatcagtagccggtctgagaggatgaacggccacattgggactgagacacggcccagactcctacgggaggcagcagtggggaatcttccacaatgggcgaaagcctgatggagcaacgccgcgtgagtgaagaaggtcttcggatcgtaaagctctgttgcacgggacgaaaaccgagcttgagaatattgagtttgggtgacggtaccgagcgaggaagccacggctaactacgtgccagcagccgcggtaatacgtaggtggcgagcgttgtccggaattattgggcgtaaagggagcgcaggcggacatataagtccatcttaaaagtgcggggctcaaccccgtgaggggatggaaactgtatgccttgagtgcaggagaggaaagcggaattcccagtgtagcggtgaaatgcgtagatattgggaggaacaccagtggcgaaggcggctttctggactgtaactgacgctgaggctcgaaagccaggggagcgaacgggattagataccccggtagtcctggccgtaaacgatgaatgctaggtgtaggaggtatcgacccctcctgtgccggagttaacgcaataagcattccgcctggggagtacggtcgcaagactgaaactcaaaggaattgacgggggcccgcacaagcggtggagtatgtggtttaattcgacgcaacgcgaagaaccttaccagggcttgacattgagtgaaagagctagagatagcttcctcccttcggggacacgaaaacaggtggtgcatggctgtcgtcagctcgtgtcgtgagatgttgggttaagtcccgcaacgagcgcaacccctgtcctttgttgccagcgcgtaatggcgggaactcaaaggagactgccgcggagaacgcggaggaaggcggggatgacgtcaagtcatcatgccccttatgtcctgggctacacacgtactacaatgggatggacagagggaagcgaaggcgcgagccggagcggaccccacaaaccatcccccagttcggattgcaggctgcaacccgcctgcatgaagtcggaatcgctagtaatcgcaggtcagcatactgcggtgaatacgttcccgggccttgtacacaccgcccgtcacaccacggaagtcattcacgcccaaagccggtgggccaaccgcaaggaggcagccgtctaaggcgggggcgatgactggggtgaagtcgtaacaaggtagccgtatcggaaggtgcggctggatcacctcctttct

SEQ ID NO: 1718 - DNA, 1490 bp, Serratia fonticola
tcagattgaacgctggcggcaggcctaacacatgcaagtcgagcggtagcacaaggagcttgctcctgggtgacgagcggcggacgggtgagtaatgtctgggaaactgcccgatggagggggataactactggaaacggtagctaataccgcataacgtcttcggaccaaagtgggggaccttcgggcctcacaccatcggatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaagggttctgtgttaatagcaccgttcattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgagcttaacttgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgagtagggctacacacgtgctacaatggcatatacaaagagaagcgaactcgcgagagcaagcggacctcataaagtatgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagttagtagcttaaccttcgggagggcgcttaccactttgtgattcatgactggggtgaagtcctaacaaggtaaccgtag

SEQ ID NO: 1719 - DNA, 1428 bp, Serratia liquefaciens
  modified_base (1070)..(1070): a, c, t, g, unknown or other
  modified_base (1070)..(1070): a, c, t, g, unknown or other
acacaagaagcttgctctctgggtgacgagcggcggacgggtgagtaatgtctgggaaactgcctgatggagggggataactactggaaacggtagctaataccgcataacgtctacggaccaaagtgggggaccttcgggcctcatgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaagggttcagtgttaatagcactgttcattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgcgcttaacgtgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaattcgctagagatagcttagtgccttcgggaactctgagacaggtgctgcatggctgtcgtcagctcgtgttgtgaaatgttgggttaagtcccgcaacgagcgcaacccttatcctttgttgccagcgcgtaatggngggaactcaaaggagactgccggtgataaaccggaggaaggtggggatgacgtcaagtcatcatggcccttacgagtagggctacacacgtgctacaatggcgtatacaaagagaagcgaactcgcgagagcaagcggacctcataaagtacgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgta

SEQ ID NO: 1720 - DNA, 939 bp, Serratia marcescens
  modified_base (35)..(35): a, c, t, g, unknown or other
  modified_base (35)..(35): a, c, t, g, unknown or other
  modified_base (75)..(76): a, c, t, g, unknown or other
  modified_base (75)..(76): a, c, t, g, unknown or other
  modified_base (81)..(82): a, c, t, g, unknown or other
  modified_base (81)..(82): a, c, t, g, unknown or other
  modified_base (120)..(120): a, c, t, g, unknown or other
  modified_base (120)..(120): a, c, t, g, unknown or other
  modified_base (122)..(122): a, c, t, g, unknown or other
  modified_base (122)..(122): a, c, t, g, unknown or other
  modified_base (129)..(129): a, c, t, g, unknown or other
  modified_base (129)..(129): a, c, t, g, unknown or other
  modified_base (131)..(132): a, c, t, g, unknown or other
  modified_base (131)..(132): a, c, t, g, unknown or other
  modified_base (141)..(141): a, c, t, g, unknown or other
  modified_base (141)..(141): a, c, t, g, unknown or other
  modified_base (165)..(165): a, c, t, g, unknown or other
  modified_base (165)..(165): a, c, t, g, unknown or other
  modified_base (294)..(294): a, c, t, g, unknown or other
  modified_base (294)..(294): a, c, t, g, unknown or other
  modified_base (484)..(484): a, c, t, g, unknown or other
  modified_base (484)..(484): a, c, t, g, unknown or other
  modified_base (492)..(492): a, c, t, g, unknown or other
  modified_base (492)..(492): a, c, t, g, unknown or other
cagccgcggtaatacggagggtgcaagcgttaatnggaaattactgggcgtaaagcgcacgcaggcggtctgatnnaagtnnagatgtgaaatccccgggcttaacctgggaatggcatntnagactgntnngctagagtnttgtagaggggggtagaattccangtgtagcggtgaaatgcgtagagatgtggaggaataccggtggcgaaggcggccccctggacaaagactgacgctcaggtgcgaaagcgtggggagcaaacaggattagataccctggtagtccacgcngtaaacgatgtcgatttgaaggttgttcccttgaggagtggctttcggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccanagaacttngcagagatgcttaggtgccttcgggaactgtgagacaggtgctgcatggctgtcgtcagctcgtgttgtgaaatgttgggttaagtcccgcaacgagcgcaacccttatcctttgttgccagcgattcggccgggaactcaaaggagactgccagtgataaaccggaggaaggtggggatgacgtcaagtcatcatggcccttacgactagggctacacacgtgctacaatggcgtatacaaagagaagcgacctcgcgagagcaagcggacctcataaagtacgtcgtagtccggattggagtctgcaactcgactccatgaagtcggaatcgctagtaatcgtagatcagaatgccacggtgaatacgttcccgggccttgtacacaccgcccgtcacaccatgggagtgggttgcaaaagaagtaggtagcttaaccttcggga

SEQ ID NO: 1721 - DNA, 1545 bp, Serratia odorifera
tttaattgaagagtttgatcatggctcagattgaacgctggcggcaggcctaacacatgcaagtcgagcggtagcacaggagagcttgctctctgggtgacgagcggcggacgggtgagtaatgtctgggaaactgcccgatggagggggataaccactggaaacggtggctaataccgcataacgtctacggaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggccaatagcttaatacgctgttggattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgcgcttaacgtgggaactgcatttgaaactggcaagctagagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggaagggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgtatacaaagagaagcgaacttgcgagagtaagcggacctcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttac

SEQ ID NO: 1722 - DNA, 1546 bp, Serratia proteamaculans
tttaattgaagagtttgatcatggctcagattgaacgctggcggcaggcctaacacatgcaagtcgagcggtagcacaagagagcttgctctctgggtgacgagcggcggacgggtgagtaatgtctgggaaactgcctgatggagggggataactactggaaacggtagctaataccgcataacgtcttcggaccaaagtgggggaccttcgggcctcacgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaagggtagtgtgttaatagcacattgcattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgcgcttaacgtgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaattcgctagagatagcttagtgccttcgggaactctgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgagtagggctacacacgtgctacaatggcgtatacaaagagaagcgaactcgcgagagccagcggacctcataaagtacgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttac

SEQ ID NO: 1723 - DNA, 1546 bp, Shewanella putrefaciens
tttaattgaagagtttgatcatggctcagattgaacgctggcggcaggcctaacacatgcaagtcgagcggcagcacaagggagtttacttctgaggtggcgagcggcggacgggtgagtaatgcctagggatctgcccagtcgagggggataacagttggaaacgactgctaataccgcatacgccctacgggggaaaggaggggaccttcgggccttccgcgattggatgaacctaggtgggattagctagttggtgaggtaatggctcaccaaggcgacgatccctagctgttctgagaggatgatcagccacactgggactgagacacggcccagactcctacgggaggcagcagtggggaatattgcacaatgggggaaaccctgatgcagccatgccgcgtgtgtgaagaaggccttcgggttgtaaagcactttcagtagggaggaaagggtgtagcttaatacgctatatctgtgacgttacctacagaagaaggaccggctaactccgtgccagcagccgcggtaatacggagggtccgagcgttaatcggaattactgggcgtaaagcgtgcgcaggcggtttgttaagcgagatgtgaaagccctgggctcaacctaggaatagcatttcgaactggcgaactagagtcttgtagaggggggtagaattccaggtgtagcggtgaaatgcgtagagatctggaggaataccggtggcgaaggcggccccctggacaaagactgacgctcatgcacgaaagcgtggggagcaaacaggattagataccctggtagtccacgccgtaaacgatgtctactcggagtttggtgtcttgaacactgggctctcaagctaacgcattaagtagaccgcctggggagtacggccgcaaggttaaaactcaaatgaattgacgggggcccgcacaagcggtggagcatgtggtttaattcgatgcaacgcgaagaaccttacctactcttgacatccacggaattggctagagatagcttagtgccttcgggaaccgtgagacaggtgctgcatggctgtcgtcagctcgtgttgtgaaatgttgggttaagtcccgcaacgagcgcaacccctatccttatttgccagcacgtaatggtgggaactctagggagactgccggtgataaaccggaggaaggtggggacgacgtcaagtcatcatggcccttacgagtagggctacacacgtgctacaatggcgagtacagagggttgcaaagccgcgaggtggagctaatctcacaaagctcgtcgtagtccggattggagtctgcaactcgactccatgaagtcggaatcgctagtaatcgtggatcagaatgccacggtgaatacgttcccgggccttgtacacaccgcccgtcacaccatgggagtgggctgcaaaagaagtgggtagcttaaccttcgggggggcgctcaccactttgtggttcatgactggggtgaagtcgtaacaaggtagccctaggggaacctggggctggatcacctccttac

SEQ ID NO: 1724 - DNA, 999 bp, Shigella boydii
  modified_base (15)..(17): a, c, t, g, unknown or other
  modified_base (15)..(17): a, c, t, g, unknown or other
  modified_base (20)..(20): a, c, t, g, unknown or other
  modified_base (20)..(20): a, c, t, g, unknown or other
  modified_base (31)..(31): a, c, t, g, unknown or other
  modified_base (31)..(31): a, c, t, g, unknown or other
  modified_base (41)..(42): a, c, t, g, unknown or other
  modified_base (41)..(42): a, c, t, g, unknown or other
  modified_base (46)..(47): a, c, t, g, unknown or other
  modified_base (46)..(47): a, c, t, g, unknown or other
  modified_base (54)..(54): a, c, t, g, unknown or other
  modified_base (54)..(54): a, c, t, g, unknown or other
  modified_base (72)..(72): a, c, t, g, unknown or other
  modified_base (72)..(72): a, c, t, g, unknown or other
  modified_base (77)..(78): a, c, t, g, unknown or other
  modified_base (77)..(78): a, c, t, g, unknown or other
  modified_base (203)..(203): a, c, t, g, unknown or other
  modified_base (203)..(203): a, c, t, g, unknown or other
  modified_base (322)..(322): a, c, t, g, unknown or other
  modified_base (322)..(322): a, c, t, g, unknown or other
  modified_base (973)..(973): a, c, t, g, unknown or other
  modified_base (973)..(973): a, c, t, g, unknown or other
tactttcagcggggnnnaanggagtaaagtnaatacctttnntcanngacgttnccgcagaagaagcaccgnctaannccgtgccagcagccgcggtaatacggagggtgcaagcgttaatcggaattactgggcgtaaagcgcacgcaggcggtttgttaagtcagatgtgaaatccccgggctcaacctgggaactgcatntgatactggcaagcttgagtctcgtagaggggggtagaattccaggtgtagcggtgaaatgcgtagagatctggaggaataccggtggcgaaggcggccccctggacgaagactgacgntcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtnacaccatgggagtgggttgcaaaaga

SEQ ID NO: 1725 - DNA, 805 bp, Shigella dysenteriae
  modified_base (21)..(22): a, c, t, g, unknown or other
  modified_base (21)..(22): a, c, t, g, unknown or other
  modified_base (272)..(272): a, c, t, g, unknown or other
  modified_base (272)..(272): a, c, t, g, unknown or other
  modified_base (436)..(436): a, c, t, g, unknown or other
  modified_base (436)..(436): a, c, t, g, unknown or other
  modified_base (523)..(523): a, c, t, g, unknown or other
  modified_base (523)..(523): a, c, t, g, unknown or other
  modified_base (536)..(536): a, c, t, g, unknown or other
  modified_base (536)..(536): a, c, t, g, unknown or other
  modified_base (561)..(561): a, c, t, g, unknown or other
  modified_base (561)..(561): a, c, t, g, unknown or other
  modified_base (603)..(603): a, c, t, g, unknown or other
  modified_base (603)..(603): a, c, t, g, unknown or other
  modified_base (621)..(621): a, c, t, g, unknown or other
  modified_base (621)..(621): a, c, t, g, unknown or other
  modified_base (642)..(642): a, c, t, g, unknown or other
  modified_base (642)..(642): a, c, t, g, unknown or other
  modified_base (669)..(669): a, c, t, g, unknown or other
  modified_base (669)..(669): a, c, t, g, unknown or other
  modified_base (684)..(684): a, c, t, g, unknown or other
  modified_base (684)..(684): a, c, t, g, unknown or other
  modified_base (687)..(687): a, c, t, g, unknown or other
  modified_base (687)..(687): a, c, t, g, unknown or other
  modified_base (699)..(699): a, c, t, g, unknown or other
  modified_base (699)..(699): a, c, t, g, unknown or other
  modified_base (713)..(713): a, c, t, g, unknown or other
  modified_base (713)..(713): a, c, t, g, unknown or other
  modified_base (730)..(730): a, c, t, g, unknown or other
  modified_base (730)..(730): a, c, t, g, unknown or other
  modified_base (754)..(754): a, c, t, g, unknown or other
  modified_base (754)..(754): a, c, t, g, unknown or other
  modified_base (770)..(770): a, c, t, g, unknown or other
  modified_base (770)..(770): a, c, t, g, unknown or other
  modified_base (778)..(778): a, c, t, g, unknown or other
  modified_base (778)..(778): a, c, t, g, unknown or other
  modified_base (791)..(792): a, c, t, g, unknown or other
  modified_base (791)..(792): a, c, t, g, unknown or other
  modified_base (797)..(797): a, c, t, g, unknown or other
  modified_base (797)..(797): a, c, t, g, unknown or other
tcgaacggtaacaggaagcannttgctgctttgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaaaggctcacctaggcgacgatccctagctggtctgagaggatgaccagccacactggaactgagacacggnccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaanaagcaccggctaactccgtgccagcagccgcggtaatacggagggtgcaagcgttaatcggaattactgggcgtaaagcgcacgcangcggtttgttaantcagatgtgaaatccccgggctcancctgggaactgcatctgatactggcaagcttgagtctcgtanaggggggtagaattccangtgtagcggtgaaatgcgtanagatctggaggaataccggtggcgaangcggccccctggacnaanactgacgctcangtgcgaaagcgtgnggagcaaacaggattanataccctggtagtccacgccgtanacgatgtcgacttggnggttgtgnccttgaggcgtgnnttccngagctaac

SEQ ID NO: 1726 - DNA, 1545 bp, Shigella flexneri
ttaaattgaagagtttgatcatggctcagattgaacgctggcggcaggcctaacacatgcaagtcgaacggtaacaggaagcagcttgctgtttcgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttactcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgctgtaaacgatgtcgacttggaggttgtgcccttgaggtgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttac

SEQ ID NO: 1727 - DNA, 1368 bp, Shigella sonnei
gcttcgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagcttgttggtggggtaacggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgacgcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagtttcagtctcgtagaatgtgccttcgggaacggtgagacagtggctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcggga

SEQ ID NO: 1728 - DNA, 1539 bp, Shuttleworthia satelles
tttaacatgagagttcgatcctggctcaggatgaacgctggcggcgtgcttaacacatgcaagtcgaacgagaaatgatattacgatctcttcggagtgacggttttatttcgagtggcggacgggtgagtaacgcgtgagcaacctgccctataccgggggataccagttggaaacgactgttaataccgcataagcgcacgataagacatcttgttgtgtgaaaaactccggtggtataggatgggctcgcgtatgattagccagttggcggggtaaaggcccaccaaagcgacgatcattagccgacctgagagggcgaccggccacattgggactgagacacggcccaaactcctacgggaggcagcagtggggaatattgcacaatgggcgaaagcctgatgcagcgacgccgcgtgagtgaggaagtatttcggtatgtaaagctctatcagcagggaagaaagaaatgacggtacctgagtaagaagctccggctaaatacgtgccagcagccgcggtaatacgtatggagcaagcgttatccggatttactgggtgtaaagggagcgtaggcggcagagcaagtctgatgtgaaagcccggggctcaaccccggtagtgcattggaaactgttcggctcgagtgtcggaggggtaagcggaattcctggtgtagcggtgaaatgcgtagatatcaggaagaacaccggaggcgaaggcggcttactggacgattactgacgctgaggctcgaaagcgtggggagcgaacaggattagataccctggtagtccacgctgtaaacgatgaatactaggtgtcggtacccgaagggtatcggtgccgtcgcaaacgcattaagtattccacctggggagtacgttcgcaagaatgaaactcaaaggaattgacggggacccgcacaagcggtggagcatgtggtttaattcgaagcaacgcgaagaaccttaccaagtcttgacatcccgatgacaagcgatgtaatgtcgtctctcttcggagcatcggagacaggtggtgcatggttgtcgtcagctcgtgtcgtgagatgttgggttaagtcccgcaacgagcgcaacccttgttcttagtagccagcaggtgaagctgggcactctaaggagactgccggggtgaacccggaggaaggtggggatgacgtcaaatcatcatgccccttatgacttgggctacacacgtgctacaatggcgtaaacaaagggaggcgaagccgtgaggccaagcgaatcccaaaaataacgtctcagttcggattgtagtctgcaactcgactacatgaagctggaatcgctagtaatcgcagatcagcatgctgcggtgaatacgttcccgggtcttgtacacaccgcccgtcacaccatgggagttggtaatgcccgaagtcagtgacccaaccgcaaggagggagctgccgaaggcaggactgataactggggtgaagtcgtaacaaggtagccgtatcggaaggtgcggctggatcacctcctttct

SEQ ID NO: 1729 - DNA, 1451 bp, Shuttleworthia sp.
  MSX8B
gaacgctggcggcgtgcttaacacatgcaagtcgaacgagaaatgatattacgatctcttcggagtgacgattttatttcgagtggcggacgggtgagtaacgcgtgagcaacctgccctgtaccgggggataccagttggaaacgactgttaataccgcataagcgcacgataagacatcttgttgtgtgaaaaactccggtggtataggatgggctcgcgtatgattagccagttggcggggtaaaggcccaccaaagcgacgatcattagccgacctgagagggcgaccggccacattgggactgagacacggcccaaactcctacgggaggcagcagtggggaatattgcacaatgggcgaaagcctgatgcagcgacgccgcgtgagtgaggaagtatttcggtatgtaaagctctatcagcagggaagaaagaaatgacggtacctgagtaagaagctccggctaaatacgtgccagcagccgcggtaatacgtatggagcaagcgttatccggatttactgggtgtaaagggagcgtaggcggcagagcaagtctgatgtgaaagcccggggctcaaccccggtagtgcattggaaactgttcagctggagtgtcggaggggtaagcggaattcctggtgtagcggtgaaatgcgtagatatcaggaagaacaccggaggcgaaggcggcttactggacgattactgacgctgaggctcgaaagcgtggggagcgaacaggattagataccctggtagtccacgctgtaaacgatgaatactaggtgtcggtacccgaagggtatcggtgccgtcgcaaacgcattaagtattccacctggggagtacgttcgcaagaatgaaactcaaaggaattgacggggacccgcacaagcggtggagcatgtggtttaattcgaagcaacgcgaagaaccttaccaagtcttgacatcccgatgacaagcgatgtaatgtcgtctctcttcggagcatcggagacaggtggtgcatggttgtcgtcagctcgtgtcgtgagatgttgggttaagtcccgcaacgagcgcaacccttgttcttagtagccagcaggtgacgctgggcactctaaggagactgccggggtgaacccggaggaaggtggggatgacgtcaaatcatcatgccccttatgacttgggctacacacgtgctacaatggcgtaaacaaagggaggcgaagccgtgaggccaagcgaatcccaaaaataacgtctcagttcggattgtagtctgcaactcgactacatgaagctggaatcgctagtaatcgcagatcagcatgctgcggtgaatacgttcccgggtcttgtacacaccgcccgtcacaccatgggagttggtaatgcccgaagtcagtgacccaaccgcaaggagggagctgccgaaggcaggactgataactggg

SEQ ID NO: 1730 - DNA, 1241 bp, Shuttleworthia sp.
  oral taxon G69
gatgaacgctggcggcgtgcttaacacaagcaagtcgaacgagaaatgatattacgatctcttcggagtgacggttttatttcgagtggcggacgggtgagtaacgcgtgagcaacctgccctgtaccgggggataccagttggaaacgactgttaataccgcataagcgcacgataagacatcttgttgtgtgaaaaactccggtggtataggatgggctcgcgtatgattagccagttggcggggtaaaggcccaccaaagcgacgatcattagccgacctgagagggcgaccggccacattgggactgagacacggcccaaactcctacgggaggcagcagtggggaatattgcacaatgggcgaaagcctgatgcagcgacgccgcgtgagtgaggaagtatttcggtatgtaaagctctatcagcagggaagaaagaaatgacggtacctgagtaagaagctccggctaaatacgtgccagcagccgcggtaatacgtatggagcaagcgttatccggatttactgggtgtaaagggagcgtaggcggcagagcaagtctgatgtgaaagcccggggctcaaccccggtagtgcattggaaactgttcagctcgagtgtcggaggggtaagcggaattcctggtgtagcggtgaaatgcgtagatatcaggaagaacaccggaggcgaaggcggcttactggacgattactgacgctgaggctcgaaagcgtggggagcgaacaggattagataccctggtagtccacgctgtaaacgatgaatactaggtgtcggtacccgaagggtatcggtgccgtcgcaaacgcattaagtattccacctggggagtacgttcgcaagaatgaaactcaaaggaattgacggggacccgcacaagcggtggagcatgtggtttaattcgaagcaacgcgaagaaccttacccagtcttgacatcccgatgacaagcgatgtaatgtcgtctctcttcggagcatcggagacagggtggtgcatggctagtcgtcagcctcgtgtcgtgagaagttggggttaagttcccgcgacgagcgccacccctggttcttgttagccagcaggtgacgctgggcaccctaggaaactggcgaggtgacccgggagaagggtgggaatacgtcaatcatcatgccccttattacctgggctacacgttcctcaagggcttacccaggggaggcaagcccgtaaggcacc

SEQ ID NO: 1731 - DNA, 1547 bp, Simonsiella muelleri
ttgaacataagagtttgatcctggctcagattgaacgctggcggcatgctttacacatgcaagtcggacggcagcggggtagtgcttgcattactgccggcgagtggcgaacgggtgagtataatattggaacgtaccgagtaatgggggataactatccgaaaggatggctaataccgcatacgtcctgagggagaaagcgggggacaggcaactgcctcgcgttatttgagcggccaatatcggattagctagttggtggggtaaaggcttaccaaggcgacgatccgtagcgggtctgagaggatgatccgccacactgggactgagacacggcccagactcctacgggaggcagcagtggggaattttggacaatggggggaaccctgatccagccatgtcgcgtgtatgaagaaggccttagggttgtaaagtacttttgttagggaagaaaaggcatttgctaatatcagatgctgatgacggtacctaaagaataagcaccggctaactacgtgccagcagccgcggtaatacgtagggtgcgagcgttaatcggaattactgggcgtaaagcgagcgcagacggttacttaagcaagatgtgaaatccccgagctcaacttgggaactgcgttttgaactgggtagctagagtgtgtcagaggggggtagaattccacgtgtagcagtgaaatgcgtagagatgtggaggaataccgatggcgaaggcagccccctgggatagcactgacgttcatgctcgaaagcgtgggtagcaaacaggattagataccctggtagtccacgccctaaacgatgtcaattagctgttggggcactagatgccttagtagcgaagctaacgcgtgaaattgaccgcctggggagtacggtcgcaagattaaaactcaaaggaattgacggggacccgcacaagcggtggatgatgtggattaattcgatgcaacgcgaagaaccttacctggtcttgacatgtacggaatctctcagagacgggagagtgccttcgggagccgtaacacaggtgctgcatggctgtcgtcagctcgtgtcgtgagatgttgggttaagtcccgcaacgagcgcaacccttgtcattagttgccatcatttggttgggcactctaatgagactgccggtgacaaaccggaggaaggtggggatgacgtcaagtcctcatggcccttatgaccagggcttcacacgtcatacaatggtcggtacagagggtagccaagccgcgaggtggagccaatcccaaaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagtaggtagaataaccgcgaggagttcgcttaccacggtatgcttcatgactggggtgaagtcgtaacaaggtagccgtaggggaacctgcggctggatcacctcctttct

SEQ ID NO: 1732 - DNA, 1474 bp, Slackia equolifaciens
agagtttgatcctggctcaggatgaacgctggcggcgtgcctaacacatgcaagtcgaacgagtaaggcgccttcgggcgcgtatagagtggcgaacgggtgagtaacacgtgaccaacctgccccccgccccgggacaaccgcccgaaagggcggctaataccgggcgaaccggagaggacgcatgccccctccggcaaagctcaggcggcgggggatggggtcgcggcccatcaggtagacggcggggtgacggcccaccgtgcctacaacgggtagccgggctgagaggccgatcggccacattgggactgagacacggcccagactcctacgggaggcagcagtggggaattttgcgcaatgggggcaaccctgacgcagcaacgccgcgtgcgggacgaaggccttcgggtcgtaaaccgctttcagcagggaagaaaccatgacggtacctgcagaagaagccccggctaactacgtgccagcagccgcggtaatacgtagggggcgagcgttatccggattcattgggcgtaaagcgcgcgcaggcggcctctcaagcggcaccgtcgaagccgggggctcaacccccggaagcgggccgaactggggggctcgaggcaggcagaggaaggcggaattcccggtgtagcggtggaatgcgcagatatcgggaagaacaccgacggcgaaggcagccttctgggcctgtcctgacgctcaggcgcgaaagccgggggagcgaacaggattagataccctggtagtcccggccgtaaacgatgggcgctaggtgtgggggcgacatgcctccgtgccgaagccaacgcattaagcgccccgcctggggagtacggccgcaaggctaaaactcaaaggaattgacgggggcccgcacaagcggcggagcatgtggcttaattcgaagcaacgcgaagaaccttaccagggcttgacatcaccgtgagccggcggagacgccggggccgagaggagcggtgacaggtggtgcatggctgtcgtcagctcgtgtcgtgagatgttgggttaagtcccgcaacgagcgcaacccctgccgtatgttgccagcatgtaacgatggggactcatacgggaccgccggcgtcaagccggaggaaggcggggacgacgtcaagtcatcatgccccttacgccctgggctgcacacgtgctacaatggccggtacagagggaagccaccccgcgagggggagccgatcccgaaaagccggccccagttcggatcggaggctgcaacccgcctccgtgaagccggagtcgctagtaatcgcggatcagcatgccgcggtgaatacgttcccgggccttgtacacaccgcccgtcacaccacccgagtcgtctgcacccgaagccgccggccgaacccgagaggggcggaggcgtcgaaggtgtggagggtgaggggggtgaagtcgtaacaaggtaacc

SEQ ID NO: 1733 - DNA, 1509 bp, Slackia exigua
ggagagtttgatcctggctcaggatgaacgctggcggcgcgcctaacacatgcaagtcgaacggttaaggccccctttagggggcgcatagagtggcgaacgggtgagtaacacgtgaccaacccgcccccccaccgggacaacctcgggaaaccgaggctaataccggatacgccggggcccccgcatgggggccccgggaaagccttggcgggaggggacggggtcgcggcccatcaggtagacggcggggcgaaggcccgccgtgccgacgacgggtagccgggctgagaggccgatcggccacattgggactgagacacggcccagactcctacgggaggcagcagtggggaatattgcgcaatggggggaaccctgacgcagcgacgccgcgtgcgggaaggaggccttcgggtcgtaaaccgctttcagcagggaagaagcctgacggtacctgcagaagaagccccggctaactacgtgccagcagccgcggtaatacgtagggggcgagcgttatccggattcattgggcgtaaagcgcgcgcaggcggcccgccaagcggcctcgtcgaagccgggggctcaacccccggaagcgacccgaactggcgggctcgagtggggcaggggaggatggaattcccggtgtagcggtgaaatgcgcagatatcgggaggaacaccgacggcgaaggcagccctctgggccttcactgacgctgaggcgcgaaagctgggggagcgaacaggattagataccctggtagtcccagccgtaaacgatgggcgctaggtgcggggggacacgaccctccgtgccgcagccaacgcattaagcgccccgcctggggagtacggccgcaaggctaaaactcaaaggaattgacgggggcccgcacaagcagcggagcatgtggcttaattcgaagcaacgcgaagaaccttaccagggcttgacatgcgggtgaagcggcggagacgccgtggccggaaggagcccgcgcaggtggtgcatggctgtcgtcagctcgtgtcgtgagatgttgggttaagtcccgcaacgagcgcaacccccgccgcatgttgccagcattcagttgggcactcatgcgggaccgccggcgccaagccggaggaaggcggggacgacgtcaagtcatcatgccccccatgccctgggccgcacacgtgctacaatggccggcacagcgggcagcggacccgcgagggcgagcgaatcccttaaagccggccccagttcggatcggaggctgcaacccgcctccgtgaagccggagttgctagtaatcgcggatcagcacgccgcggtgaatgcgttcccgggccttgtacacaccgcccgtcacaccacccgagtcgtctgcacccgaagccgccggcccaacccgcaagggggggaggcgtcgaaggtgtggagggtgaggggggtgaagtcgtaacaaggtagccgtaccggaaggtgcggctggatcacctcctttct

SEQ ID NO: 1734 - DNA, 1476 bp, Slackia faecicanis
gatgaacgctggcggcgtgcctaacacatgcaagtcgaacggttaaggcgccttcgggcgcgaatagagtggcgaacgggtgagtaacgcgtggccaacctgccccctcctccgggacaacctcgggaaaccgaggctaataccggatgctccgggccccccgcatggggggcccgggaaagcccaggcgggaggggatggggccgcgtcccatcaggtagtaggcggggtgacggcccacctagctgacgacgggtagccggactgagaggtcgatcggccacattgggactgagacacggcccagactcctacgggaggcagcagtggggaattttgcgcaatgggggaaaccctgacgcagcaacgccgcgtgcgggacgaaggccttcgggtcgtaaaccgctttcggcagggaagaattttgacggtacctgcagaagaagccccggctaactacgtgccagcagccgcggtaatacgtagggggcgagcgttatccggattcattgggcgtaaagcgcgcgtaggcgtctcctcaagcggcaccgtcgaagccgggggctcaacccccggaagcgggccgaactggggggatcgagtgcggtaggggcaggcggaattcccggtgtagcggtgaaatgcgcagatatcgggaagaacaccgacggcgaaggcagcctgctgggccggcactgacgctgaggcgcgaaagctgggggagcgaacaggattagataccctggtagtcccagccgtaaacgatgggcgctaggtgtgggggagccattcctccgtgccgcagccaacgcattaagcgccccgcctggggagtacggccgcaaggctaaaactcaaaggaattgacgggggcccgcacaagcagcggagcatgtggcttaattcgaagcaacgcgaagaaccttaccagggcttgacatcaccgtgagccggcggagacgccggggccgaaaggagcggtgacaggtggtgcatggctgtcgtcagctcgtgtcgtgagatgttgggttaagtcccgcaacgagcgcaacccccgccgtatgttgccatcgggtaatgccgggcactcgtacgggaccgccggagccaatccggaggaaggcggggacgacgtcaagtcatcatgcccctcatgccctgggctgcacacgtgctacaatggccggtacaacgggccgccacgccgcgaggcggagcgaatccctcaaagccggccccagttcggatcgcaggctgcaacccgcctgcgtgaagccggagttgctagtaatcgcggatcagcatgccgcggtgaatacgttcccgggccttgtacacaccgcccgtcacaccacccgagtcgtctgcacccgaagccgccggccgaacccgaaaggggcggaggcgtcgaaggtgtggagggtgaggggggtgaagtcgtaacaaggtagccgtaccggaaggtgcggctggatc

SEQ ID NO: 1735 - DNA, 1505 bp, Slackia heliotrinireducens
agagtttgatcctggctcaggatgaacgctggcggcgcgcctaacacatgcaagtcgaacgattaaaccgccctcgggcggacatacagtggcgaacgggtgagtaacacgtgaccaacccgccccctcctccgggacaacctcgggaaaccgtggctaataccggatactccggcagcagcgcatgctgcggccgggaaagcccagacgggaggggatggggtcgcggcccatcaggtagacggcggggcaacggcccgccgtgccgacgacgggtagccgggctgagaggctgatcggccacattgggactgagacacggcccagactcctacgggaggcagcagtggggaatcttgcgcaatggggggaaccctgacgcagcgacgccgcgtgcgggacgaaggccttcgggtcgtaaaccgctttcagcagggaagaaacatgacggtacctgcagaagaagctccggctaactacgtgccagcagccgcggtaatacgtagggagcgagcgttatccggattcattgggcgtaaagcgcgcgcaggcggccggccaagcgggcctcgtcgaagccgtgggctcaacccgcggaagcgacccgaactggccggctcgagtgaggtaggggaggatggaattcccggtgtagcggtggaatgcgcagatatcgggaggaacaccgacggcgaaggcagtcctctgggccttcactgacgctgaggcgcgaaagctgggggagcgaacaggattagataccctggtagtcccagccgtaaacgatgggcgctaggtgtggggggccggaccccccgtgccgcagccaacgcattaagcgccccgcctggggagtacggccgcaaggctaaaactcaaaggaattgacgggggcccgcacaagcagcggagcatgtggcttaattcgaagcaacgcgaagaaccttaccagggcttgacatgcaggtgaagcggcggaaacgccgtggcctgaccggagcctgcacaggtggtgcatggctgtcgtcagctcgtgtcgtgagatgttgggttaagtcccgcaacgagcgcaacccctgccgcatgttgccagcatcaagttggggactcatgcgggaccgccggcgccaagccggaggaaggcggggacgacgtcaagtcatcatgcccctcatgccctgggctgcacacgtgctacaatggccggcacagcgggctgcgacgcagcgatgcggagcgaatccctcaaagccggccccagttcggatcggaggctgcaacccgcctccgtgaagccggagttgctagtaatcgcggatcagcacgccgcggtgaatgcgttcccgggccttgtacacaccgcccgtcacaccacccgagtcgtctgcacccgaagccgccggccgaacccgttaaggggcggaggcgtcgaaggtgtggagggtgaggggggtgaagtcgtaacaaggtagccgtacgggaacgtgcggctggatcacctcctt

SEQ ID NO: 1736 - DNA, 1473 bp, Slackia isoflavoniconvertens
agagtttgatcctggctcaggatgaacgctggcggcgcgcctaacacatgcaagtcgaacgagtaagacgccttcgggcgtggatagagtggcgaacgggtgagtaacacgtgaccaacctgccccctcctccgggacaacctcgggaaaccgaggctaataccggatactccgggcaccccgcatgggatgcccgggaaagccctggcgggaggggatggggtcgcggcccatcaggtagacggcggggtaacggcccaccgtgcccgcaacgggtagccgggctgagaggccgatcggccacattgggactgagacacggcccagactcctacgggaggcagcagtggggaattttgcgcaatgggggcaaccctgacgcagcgacgccgcgtgcgggacgaagtcattcgtgacgtaaaccgctttcagcgaggaagaaccatgacggtactcgcagaagaagccccggctaactacgtgccagcagccgcggtaatacgtagggggcgagcgttatccggaatcattgggcgtaaagcgcgcgcaggcgggctttcaagcggcggcgtcgaagccgggggctcaacccccggaagcgccccgaactggaagcctcggatgcggcagggggaggcggaattcccggtgtagcggtgaaatgcgcagatatcgggaagaacaccgacggcgaaggcagcctcctgggccggcatcgacgctgaggcgcgaaagctgggggagcgaacaggattagataccctggtagtcccagccgtaaacgatggacgctaggtgtgggggaggaatctcctccgtgccgaagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatatcggtgaagccggagagatccggtggccgagaggagcccacacaggtggtgcatggctgtcgtcagctcgtgccgtgaggtgttgggttaagtcccgcaacgagcgcaacccccgccgcgtgttgccagcattcagttgggcactcacgcgggactgccggcgtcaagccggaggaaggcggggacgacgtcaagtcatcatgcccctcatgccctgggccgcacacgtgctacaatggccggcacaacgggttgccaccccgcgagggggagcggatccctaaagccggccccagttcggatcgcaggctgcaacccgcctgcgtgaagccggagttgctagtaatcgcggatcagcacgccgcggtgaatacgttcccgggccttgtacacaccgcccgtcacaccacccgagtcgtctgcacccgaagccgccggccgaacccctccggggggcggaggcgtcgaaggtgtggagggtgaggggggtgaagtcgtaacaaggtaacc

SEQ ID NO: 1737 - DNA, 1463 bp, Slackia piriformis
gatgaacgctggcggcgtgcctaacacatgcaagtcgaacggttaaggcgccttcgggcgcgcatagagtggcgaacgggtgagtaacacgtgaccaacctgccccctcctccgggacaacctcgggaaaccgaggctaataccggatggtcccgccgggccgcatggccgggcggggaaagcccaggcgggaggggatggggtcgcggcccatcaggtagtaggcggggtgacggcccacctagctgacgacgggtagccgcgctgagaggcggaccggccacattgggactgagacacggcccagactcctacgggaggcagcagtggggaattttgcgcaatgggggaaaccctgacgcagcaacgccgcgtgcgggacgaaggccttcgggtcgtaaaccgctttcagcagggaagaagaatgacggtacctgcagaagaagccccggctaactacgtgccagcagccgcggtaatacgtagggggcgagcgttatccggattcattgggcgtaaagcgcgcgtaggcgtcccttcaagcggcaccgtcgaagccgggggctcaacccccggaagcgggccgaactggggggatcgagtgcggtaggggaaggcggaattcccggtgtagcggtgaaatgcgcagatatcgggaagaacaccgacggcgaaggcagccttctgggccgccactgacgctgaggcgcgaaagctgggggagcgaacaggattagataccctggtagtcccagccgtaaacgatgggcgctaggtgtggggggagatgtccctccgtgccgcagccaacgcattaagcgccccgcctggggagtacggccgcaaggctaaaactcaaaggaattgacgggggcccgcacaagcagcggagcatgtggcttaattcgaagcaacgcgaagaaccttaccagggcttgacatcaccgtgagccgccggagacggcggggccgaaaggagcggtgacaggtggtgcatggctgtcgtcagctcgtgtcgtgagatgttgggttaagtcccgcaacgagcgcaacccccgccgcgtgttgccagcattgagttgggcactcgcgcgggactgccggcgtcaagccggaggaaggtggggacgacgtcaagtcatcatgcccctcatgccctgggctgcacacgtgctacaatggccggtacagcgggctgcgacgccgcgaggcggagcgaatcccacaaagccggccccagttcggaccgcaggctgcaacccgcctgcgcgaagccggagttgctagtaatcgcggatcagcatgccgcggtgaatacgttcccgggccttgtacacaccgcccgtcacaccacccgagtcgtctgcacccgaagccgccggccgaacccgcaaggggcggaggcgtcgaaggtgtggagggtgaggggggtgaagtcgtaacaaggtagccgtaccggaagg

SEQ ID NO: 1738 - DNA, 1355 bp, Slackia sp.
  NATTS
tttgatcatggctcaggatgaacgctggcggcgcgcctaacacatgcaagtcgaacgagtggcgaacgggtgagtaacacgtgaccaacctgccccctcctccgggacaacctcgggaaaccgaggctaataccggatactgaaaggcgggaggggatggggtcgcggcccatcaggtagacggcggggtaacggcccaccgtgcctgcaacgggtagccgggctgagaggccgatcggccacattgggactgagacacggcccagactcctacgggaggcagcagtggggaattttgcgcaatgggggcaaccctgacgcagcgacgccgcgtgcgggacgaagtcattcgtgacgtaaaccgctttcagcgaggaagatgacggtactcgcagaagaagccccggctaactacgtgccagcagccgcggtaatacgtagggggcgagcgttatccggaatcattgggcgtaaagcgcgcgcaggcgggctttcaagcggggcgtcgaagccgggggctcaacccccggaagcgccccgaactggaagcctcggatgcggcagggggaggcggaattcccggtgtagcggtgaaatgcgcagatatcgggaagaacaccgacggcgaaggcagcctcctgggccgatcgacgctgaggcgcgaaagctgggggagcgaacaggattagataccctggtagtcccagccgtaaacgatggacgctaggtgtgggggcctccgtgccgaagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatatacaggtggtgcatggctgtcgtcagctcgtgccgtgaggtgttgggttaagtcccgcaacgagcgcaacccccgccgcgtgttgccagcatgggcactcacgcgggactgccggcgtcaagccggaggaaggcggggacgacgtcaagtcatcatgcccctcatgccctgggccgcacacgtgctacaatggccggcaacgggttgccaccccgcgagggggagcggatccctccggccccagttcggacgcaggctgcaacccgcctgcggaagccggagttgctagtaatcgcggatcagcacgccgcggtgaatacgttcccgggccttgtacacaccgcccgtcacaccacccgagtcgtctgcacccgaagccgccgccgacggaggcgtcgaaggtgtggagggtgaggggggtgaagtcgtaacaaggtagccgtaccggaaggtgcggctggatcacct

SEQ ID NO: 1739 - DNA, 1528 bp, Solobacterium moorei
tcaaatgaagagtttgatcctggctcaggatgaacgctggcggcgtgcctaatacatgcaagtcgaacgctggagatctagcttgctagatcgaaggagtggcgaacgggtgagtaatacataagcaacctacccacgaagactgggataatctctggaaacggggactaataccggataggtaatcggaaggcatcttctggttattaaaggttaaaaacactggtggatgggcttatggcgcattagttagttggtgaggtaacggcccaccaagacgatgatgcgtagccggcctgagagggtgaacggccacattgggactgagacacggcccagactcctacgggaggcagcagtagggaattttcggcaatgggggcaaccctgaccgagcaacgccgcgtgagtgaagacggccttcgggttgtaaagctctgttgtaagggaagaacggtagatagagaatatctaagtgacggtaccttaccagaaagccacggctaactacgtgccagcagccgcggtaatacgtaggtggcgagcgttatccggaattattgggcgtaaagggtgcgtaggcggcctgttaagtaagtggttaaattgttgggctcaacccaatccagccacttaaactggcaggctagagtattggagaggcaagtggaattccatgtgtagcggtaaaatgcgtagatatatggaggaacaccagtggcgaaggcggcttgctagccaaagactgacgctcatgcacgaaagcgtggggagcaaataggattagataccctagtagtccacgccgtaaacgatgaatactaagtattggggaaactcagtgctgcagctaacgcaataagtattccgcctgtggagtatgcacgcaagtgtgaaacataaaggaattgacgggggcccgcacaagcggtggagtatgtggtttaattcgacgcaacgcgaagaaccttaccaggccttgacatcccttgcaaagctgtagagatacagtagaggttatcaaggagacaggtggtgcatggttgtcgtcagctcgtgtcgtgagatgttgggttaagtcccgcaacgagcgcaacccttgccttcagttaccagcattcagttggggactctggagggactgccggtgataaaccggaggaaggtggggatgacgtcaaatcatcatgccccttatggcctgggctacacacgtactacaatggctgttacaacgtgcagcgacctagcgataggaagcgaatcactaaaagacagtctcagttcggattgaagtctgcaactcgacttcatgaagctggaatcgctagtaatcgcggatcagaatgccgcggtgaatacgttctcgggccttgtacacaccgcccgtcataccatgagagctggtaatacccgaagccggtggcctaaccgcaaggaaggagccgtcgaaggtaggactagtgattggggtcaagtcgtaacaaggtatccctacgagaacgtggggatggatcacctcctttct

SEQ ID NO: 1740 - DNA, 1494 bp, Sphingobacterium faecium
ggctcaggatgaacgctagcggcaggcctaatacatgcaagtcggacgggattcagggagtagcttgctacgaactgatgagagtggcgcacgggtgcgtaacgcgtgagcaacctacccatatcagggggatagcctctcgaaagagagattaacaccgcataacatcatttaccggcatcggttaatgatcaaatatttataggatatggatgggctcgcgtgacattagctagttggaggggtaacggcccaccaaggctacgatgtctaggggctctgagaggagaatcccccacactggtactgagacacggaccagactcctacgggaggcagcagtaaggaatattggtcaatggagggaactctgaaccagccatgccgcgtgcaggatgactgccctatgggttgtaaactgcttttgtcagggaataaacctttctacgtgtaggaagctgaatgtacctgaagaataaggatcggctaactccgtgccagcagccgcggtaatacggaggatccaagcgttatccggatttattgggtttaaagggtgcgtaggcggtcctataagtcagtggtgaaagacggcagcttaactgtcgcagtgcctttgatactgtaggacttgaatctatttgaagtgggcggaataagacaagtagcggtgaaatgcatagatatgtcttagaactccgattgcgaaggcagctcactaagttagtattgacgctgatgcacgaaagcgtggggatcaaacaggattagataccctggtagtccacgccctaaacgatgataactcgatgtttgcgatacacagtaagcgtccaagcgaaagcgttaagttatccacctggggagtacggtcgcaagattgaaactcaaaggaattgacgggggcccgcacaagcggaggagcatgtggtttaattcgatgatacgcgaggaaccttacccgggcttgaaagttagtgaatgatccagagacggatcagtccttcgggacacgaaactaggtgctgcatggctgtcgtcagctcgtgccgtgaggtgttgggttaagtcccgcaacgagcgcaacccctatgtttagttgccagcatgtaatgatggggactctaaacagactgccagcgtaagctgtgaggaaggtggggacgacgtcaagtcatcatggcccttacgtccggggctacacacgtgctacaatggatggtacagcgggcagctacatagcaatatgatgctaatctctaaaagccattcacagttcggattgaggtctgcaactcgacctcatgaagttggattcgctagtaatcgcgtatcagcaatgacgcggtgaatacgttcccgggccttgtacacaccgcccgtcaagccatgaaagttgggggtacctaaagcatgtaaccgcaaggagcgtgttagggtaaaaccgataattggggctaagtcgtaacaaggtagccgtaccggaaggtgcgg

SEQ ID NO: 1741 - DNA, 1454 bp, Sphingobacterium mizutaii
gctcaggatgaacgctagcggcaggcctaatacatgcaagtcggacgggatccatcggtagcttgctaccgatggtgagagtggcgcacgggtgcgtaacgcgtgagcaacctgcccatatcagggggatagcccggagaaatccggattaacaccgcatgacactgctttccggcatcgggaggtagtcaaatattcataggatatggatgggctcgcgtgacattagctagttggtggggtaacggcccaccaaggcgacgatgtctaggggctctgagaggagaatcccccacactggtactgagacacggaccagactcctacgggaggcagcagtaaggaatattggtcaatgggggcaaccctgaaccagccatgccgcgtgcaggacgactgccctatgggttgtaaactgcttttgttagggaataaaccccgctacgtgtagcgggctgaatgtacctaaagaataaggatcggctaactccgtgccagcagccgcggtaatacggaggatccgagcgttatccggatttattgggtttaaagggtgcgtaggcggcactttaagtcaggggtgaaagacggcagctcaactgtcgcagtgcccttgatactgaagtgcttgaatgcggttgaagacggcggaatgagacaagtagcggtgaaatgcatagatatgtctcagaacaccgattgcgaaggcagctgtctaagccgttattgacgctgatgcacgaaagcgtggggatcgaacaggattagataccctggtagtccacgccctaaacgatgatgactcgatgtttgcgatataccgtaagcgtccaagcgaaagcgttaagtcatccacctggggagtacgcccgcaagggtgaaactcaaaggaattgacgggggcccgcacaagcggaggagcatgtggtttaattcgatgatacgcgaggaaccttacccgggcttgaaagttactgaagggcgcagagacgcgcccgtccttcgggacaggaaactaggtgctgcatggctgtcgtcagctcgtgccgtgaggtgttgggttaagtcccgcaacgagcgcaacccctatgtttagttgccagcacgtcaaggtggggactctaaacagactgcctgcgcaagcagagaggaaggcggggacgacgtcaagtcatcatggcccttacgtccggggctacacacgtgctacaatggatggtacagcgggcagctacacagcaatgtggtgccaatctcgaaaagccattcacagttcggatcggggtctgcaactcgaccccgtgaagttggattcgctagtaatcgcgtatcagcaatgacgcggtgaatacgttcccgggccttgtacacaccgcccgtcaagccatgaaagctgggggtacctaaagcatgtaaccgcaaggagcgtgttagggtaaaaccggtaattgggg

SEQ ID NO: 1742 - DNA, 1439 bp, Sphingobacterium multivorum
  modified_base (1112)..(1112): a, c, t, g, unknown or other
  modified_base (1112)..(1112): a, c, t, g, unknown or other
  modified_base (1114)..(1114): a, c, t, g, unknown or other
  modified_base (1114)..(1114): a, c, t, g, unknown or other
ggctcaggatgaacgctagcggcaggcctaatacatgcaagtcggacgggatccatcggagagcttgctcgaagatggtgagagtggcgcacgggtgcgtaacgcgtgagcaacctacctctatcagggggatagcctctcgaaagagagattaacaccgcataacatcaacagttcgcatgttcggttgattaaatatttataggatagagatgggctcgcgtgacattagctagttggtagggtaacggcttaccaaggcgacgatgtctaggggctctgagaggagaatcccccacactggtactgagacacggaccagactcctacgggaggcagcagtaaggaatattggtcaatgggcggaagcctgaaccagccatgccgcgtgcaggatgactgccctatgggttgtaaactgcttttgtccaggaataaacctaaatacgtgtatttagctgaatgtactggaagaataaggatcggctaactccgtgccagcagccgcggtaatacggaggatccgagcgttatccggatttattgggtttaaagggtgcgtaggcggcctattaagtcaggggtgaaatacggtggctcaaccatcgcagtgcctttgatactgatgggcttgaatccatttgaagtgggcggaataagacaagtagcggtgaaatgcatagatatgtcttagaactccgattgcgaaggcagctcactaagctggtattgacgctgatgcacgaaagcgtggggatcgaacaggattagataccctggtagtccacgccctaaacgatgataactcgatgttggcgatagacagccagcgtcccagcgaaagcgttaagttatccacctggggagtacgcccgcaagggtgaaactcaaaggaattgacgggggcccgcacaagcggaggagcatgtggtttaattcgatgatacgcgaggaaccttacccgggcttgaaagttagtgaagagtgcagagacgcactcgtccttcgggacacgaaactaggtgctgcatggctgtcgtcagctcgtgccgtgaggtgttgggttaagtcccgcaacgagcgcaacccctatgtttagttgccagcatgtnanggtggggactctaaacagactgcctgtgcaaacagagaggaaggtggggacgacgtcaagtcatcatggcccttacgtccggggctacacacgtgctacaatggatggtacagcgggcagctacatagcaatatgatgctaatctctaaaagccattcacagttcggattggggtctgcaactcgaccccatgaagttggattcgctagtaatcgcgtatcagcaatgacgcggtgaatacgttcccgggccttgtacacaccgcccgtcaagccatgaaagttgggggtacctaaagcatgttaccgcaaggagcgtgttaggg

SEQ ID NO: 1743 - DNA, 1527 bp, Sphingobacterium spiritivorum
ttacaatggagagtttgatcctggctcaggatgaacgctagcggcaggcctaatacatgcaagtcgaacgagattatccagcttgctggatatgaaagtggcgcacgggtgcgtaacgcgtgagcaacctacctctgtcagggggatagcccggcgaaagtcggattaacaccgcatgacattattgatgtggcatcacattataatcaaatatttataggacagagatgggctcgcgtgacattagctagttggagaggtaacggctcaccaaggcaacgatgtctaggggctctgagaggagaatcccccacactggtactgagacacggaccagactcctacgggaggcagcagtaaggaatattggtcaatggagggaactctgaaccagccatgccgcgtgcaggatgactgccctatgggttgtaaactgcttttgtcggggaataaacctacgtttgtaaacgtagctgaatgtacccgaagaataaggatcggctaactccgtgccagcagccgcggtaatacggaggatccaagcgttatccggatttattgggtttaaagggtgcgtaggcggttctttaagtcagaggtgaaagacggcagcttaactgtcgcagtgcctttgatactgaagaacttgaattaggttgaggaatgcggaatgagacaagtagcggtgaaatgcatagatatgtctcagaaccccgattgcgaaggcagcattccaagcctttattgacgctgatgcacgaaagcgtggggatcgaacaggattagataccctggtagtccacgccctaaacgatgataactcgatgttggcgatagacagtcagcgtcccagcgaaagcgttaagttatccacctggggagtacgcccgcaagggtgaaactcaaaggaattgacgggggcccgcacaagcggaggagcatgtggtttaattcgatgatacgcgaggaaccttacccgggcttgaaagttagtgaatgatccagagacggatcagtccttcgggacacgaaactaggtgctgcatggctgtcgtcagctcgtgccgtgaggtgttgggttaagtcccgcaacgagcgcaacccctatgtttagttgccagcatgtcatgatggggactctaaacagactgcctgcgcaagcagagaggaaggtggggacgacgtcaagtcatcatggcccttacgtccggggctacacacgtgctacaatggtcggtacagcgggcagctacacagtaatgtgatgccaatctctgaaagccgatcacagttcggattgaggtctgcaactcgacctcatgaagttggattcgctagtaatcgcgtatcagcaatgacgcggtgaatacgttcccgggccttgtacacaccgcccgtcaagccatgaaagttgggggtgcctaaagcatgtaaccgcaaggagcgtgttagggcaaaaccgataattggggctaagtcgtaacaaggtagccgtaccggaaggtgcggctggaatacctcctttct

SEQ ID NO: 1744 - DNA, 1463 bp, Sphingomonas echinoides
  modified_base (439)..(439): a, c, t, g, unknown or other
  modified_base (439)..(439): a, c, t, g, unknown or other
  modified_base (956)..(959): a, c, t, g, unknown or other
  modified_base (956)..(959): a, c, t, g, unknown or other
tgatcatggctcagaatgaacgctggcggcatgcctaacacatgcaagtcgaacgaaggctttggccttagtggcgcacgggtgcgtaacgcgtgggaatctgccctcaggttcggaataacagcgagaaattgctgctaataccggatgatatcgcgagatcaaagatttatcgcctgaggatgagcccgcgtaggattagctagttggtgtggtaaaggcgcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctnactccgtgccagcagccgcggtaatacggagggagctagcgttattcggaattactgggcgtaaagcgcacgtaggcggctttgtaagttagaggtgaaagcctggagctcaactcctgaattgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtcggggctcttagagcttcggtggcgcacgtaacgcattaagttatccgcctggggagtacggccgcaaggttaaaactcaaatgaattgacgggggcctgcacaagcggtggagcatgtggtttaattcgaagcaacgcgcagaaccttaccagcgtttgacatgtccggacgatttcgggagaccgatctcnnnntcggggactggaacacaggtgctgcatggctgtcgtcagctcgtgtcgtgagatgttgggttaagtcccgcaacgagcgcaaccctcgtccttagttgccatcattcagttgggcactctaaggaaaccgccggtgataagccggaggaaggtggggatgacgtcaagtcctcatggcccttacgcgctgggctacacacgtgctacaatggcggtgacagtgggcagcaatctcgcaagggtgagctaatctccaaaagccgtctcagttcggattgttctctgcaactcgagagcatgaaggcggaatccgtagtaatcgcggatcagcatgccgcggtgaatacgttcccaggccttgtacacaccgcccgtcacaccatgggagttggattcacccgaaggcagtgcgctaaccgcaaggaggcagctgaccacggtgggttcagcgactggggtgaagtcgtaacaaggtagccgtaggggaacctgcggctggatcac

SEQ ID NO: 1745 - DNA, 1362 bp, Sphingomonas sp.
  oral clone FI012
gagtttgatcctggctcagaacgaacgctggcggcgtgcctaacacatgcaagtcgaacgagtggcgcacgggtgcgtaacgcgtgggaatctgcctcttgcttcggaataacagtgggaaactactgctaataccggatgatcaaagtcggcaagagatgagcccgcgtaggattaggtagttggtggggtaaaggcctaccaagccgacgatccttagctggtctgagaggatgatcagccacactgggactgagacacggcccagactcctacgggaggcagcagtggggaatattggacaatgggggcaaccctgatccagcaatgccgcgtgagtgatgaaggccttagggttgtaaagctcttttaccagggatgatgacagtacctggagaataagctccggctaactccgtgccagcagccgcggtaatacggagggagctagcgttgttcggaattactgggcgtaaagcgcacgtaggcggttactcaagtcagaggtgaaagcccggggctcaaccccggaactgcctttgaaactaggtaactagaatcctggagaggtgagtggaattccgagtgtagaggtgaaattcgtagatattcggaagaacaccagtggcgaaggcggctcactggacagattgacgctgaggtgcgaaagcgtggggagcaaacaggattagatacccaggtagtccacgccgtaaacgatgataactagctgtccgggtttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcgacaggtgctgcatggctgtcgtcagctcgtgtcgtgagatgttgggttaagtcccgcaacgagcgcaaccctcgtccttagttgccatcatgggcactctaaggaaaccgccggtgataagccggaggaaggtggggatgacgtcaagtcctcatggcccttacacgctgggctacacacgtgctacaatggcggtcagtgggcagcgacctcgcgaggggtagctaatctccgccgtctcagttcggatgttctctgcaactcgagagcagaaggcggaatcgctagtaatcgcggatcagcatgccgcggtgaatgcgttcccaggccttgtacacaccgcccgtcacaccatgggagttggattcactcgaaggcgttaggtaggtaggcgaccacagtgggtttagcgactggggtgaagtcgtaacaaggtagccgtaggggaacctgcggttggatcacctcctt

SEQ ID NO: 1746 - DNA, 1362 bp, Sphingomonas sp.
  oral clone FZ016
gagtttgattctggctcagaacgaacgctggcggcatgcctaatacatgcaagtcgaacgagtggcgcacgggtgcgtaacgcgtgggaatctgcccttgggttcggaataacagctggaaacggctgctaataccggatgatcaaagtcgcccagggatgagcccgcgtaggattagctagttggtggggtaaaggcctaccaaggcgacgatccttagctggtctgagaggatgatcagccacactgggactgagacacggcccagactcctacgggaggcagcagtagggaatattggacaatgggggcaaccctgatccagcaatgccgcgtgagtgatgaaggccttagggttgtaaagctcttttacccgagatgatgacagtatcgggagaataagctccggctaactccgtgccagcagccgcggtaatacggagggagctagcgttgttcggaattactgggcgtaaagcgcacgtaggcggcgatttaagtcagaggtgaaagcccggggctcaaccccggaactgcctttgagactggattgcttgaatccgggagaggtgagtggaattccgagtgtagaggtgaaattcgtagatattcggaagaacaccagtggcgaaggcggctcactggaccgattgacgctgaggtgcgaaagcgtggggagcaaacaggattagataccctggtagtccacgccgtaaacgatgataactagctgccggggtttcggtggcgcagctaacgcattaagttatccgcctggggagtacggtcgcaagattaaaactcaaaggaattgacgggggcctgcacaagcggtggagcatgtggtttaattcgaagcaacgcgcagaaccttaccaacgtttgacatcgacaggtgctgcatggctgtcgtcagctcgtgtcgtgagatgttgggttaagtcccgcaacgagcgcaaccctcgcctttagttgccagcatgggtactctaaaggaaccgccggtgataagccggaggaaggtggggatgacgtcaagtcctcatgscccttacgcgttgggctacacacgtgctacaatggcgaccagtgggcagcgaccgtgcgagcggaagctaatctccgtcgtctcagttcgggcgttctctgcaactcgagagcggaaggcggaatcgctagtaatcgcggatcagcatgccgcggtgaatacgttcccaggccttgtacacaccgcccgtcacaccatgggagttggattcactcgaaggcgttagctaggcaggcgaccacagtgggtttagcgactggggtgaagtcgtaacaaggtagccgtaggggaacctgcggctggatcacctcctt

SEQ ID NO: 1747 - DNA, 1405 bp, Sphingomonas sp.
  oral taxon A09
agagtttgatcctggctcagaatgaacgctggcggcatgcctaacacatgcaagtcgaacgaagccttcgggcttagtggcgcacgggtgcgtaacgcgtgggaatctgcccttgggttcggaataacagttggaaacgactgataataccggatgatgacgtaagtccaaagatttatcgcccaaggatgagcccgcgtaggattagctagttggtgaggtaaaggctcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttattcggaattactgggcgtaaagcgcacgtaggcggctttgtaagttagaggtgaaagcccagagctcaactctggaattgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgttcggggacttagtccgtgagtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatggtaggacgactggcagagatgcctttcttcccttcggggacctacacacaggtgctgcatggctgtcgtcagctcgtgtcgtgagatgttgggttaagtcccgcaacgagcgcaaccctcgcctttagttgccatcatttagttgggcactctaaaggaaccgccggtgataagccggaggaaggtggggatgacgtcaagtcctcatggcccttacgcgctgggctacacacgtgctacaatggcggtgacagtgggcagcaatcccgcaagggggagctaatctccaaaagccgtctcagttcggattgcactctgcaactcgagtgcatgaaggcggaatcgctagtaatcgcggatcagcacgccgcggtgaatacgttcccaggccttgtacacaccgcccgtcacaccatgggagttgggttcacccgaaggcgttgcgctaactcgcaagagaggcaggcgacc

SEQ ID NO: 1748 - DNA, 1450 bp, Sphingomonas sp.
  oral taxon F71
agagtttgatcctggctcagaacgaacgctggcggcacgcctaacacatgcaagtcgaacgaaggcttcggccttagtggcgcacgggtgcgtaacgcgtgggaatctgcccttgggtctgggataacggcgggaaactgccgctaataccggatgatatcgcgagatcaaagatttatcgcctgaggatgagcccgcgtaggattaggtagttggtgtggtaaaggcgcaccaagccgacgatccttagctggtctgagaggatgatcagccacactgggactgagacacggcccagactcctacgggaggcagcagtggggaatattggacaatgggcgcaagcctgatccagcaatgccgcgtgagtgatgaaggccttagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcaggggtgaaagcctggagctcaactccagaactgcctttgagactgcatcgcttgaatccgggagaggtgagtggaattccgagtgtagaggtgaaattcgtagatattcggaagaacaccagtggcgaaggcggctcactggaccggtattgacgctgaggtgcgaaagcgtggggagcaaacaggattagataccctggtagtccacgccgtaaacgatgataactagctgtccgggggcttggcctttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgactggcagagatgcctttcttcccttcggggactggaacacaggtgctgcatggctgtcgtcagctcgtgtcgtgagatgttgggttaagtcccgcaacgagcgcaaccctcgcctttagttaccatcatttggttgggtactctaaaggaaccgccggtgataagccggaggaaggtggggatgacgtcaagtcctcatggcccttacgcgctgggctacacacgtgctacaatggcggtgacagtgggcagcaatcccgcgagggtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttgggttcacccgaaggcgttgcactaactcgcaagagaggcaggcgaccacggtgggcttagcgactggggtgaagtcgtaacaaggtagccgt

SEQ ID NO: 1749 - DNA, 1484 bp, Sphingopyxis alaskensis
ttgagagtttgatcctggctcagaacgaacgctggcggcatgcctaacacatgcaagtcgaacgagaccttcgggtctagtggcgcacgggtgcgtaacgcgtgggaatctgcccttgggtacggaataactcagagaaatttgagctaataccgtataatgacttcggtccaaagatttatcgcccaaggatgagcccgcgtaagattagctagttggtggggtaaaggcctaccaaggcgacgatctttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcgcgtaggcggttttttaagtcagaggtgaaagcccagtgctcaacactggaactgcctttgaaactggaaaacttgaatcttggagaggtcagtggaattccgagtgtagaggtgaaattcgtagatattcggaagaacaccagtggcgaaggcgactgactggacaagtattgacgctgaggtgcgaaagcgtggggagcaaacaggattagataccctggtagtccacgccgtaaacgatgataactagctgtccgggttcatggaacttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctgatcgcggattagagagatcttttccttcagttcggctggatcagtgacaggtgctgcatggctgtcgtcagctcgtgtcgtgagatgttgggttaagtcccgcaacgagcgcaaccctcatccctagttgccatcattcagttgggcactctaaggaaactgccggtgataagccggaggaaggtggggatgacgtcaagtcctcatggcccttacgcgctgggctacacacgtgctacaatggcaactacagtgggcagcaacctcgcgaggggtagctaatctccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggcagtgctctaacccgcaagggaggaagctgaccacggtgggatcagcgactggggtgaagtcgtaacaaggtagccgtaggggaacctgcggctggatcacctcctt

SEQ ID NO: 1750 - DNA, 1515 bp, Spiroplasma insolitum
tggagagtttgatcctggctcaggatgaacgctggcggcatgcctaatacatgcaagtcgaacggggtgcttgcacccagtggcgaacgggtgagtaacacgtatctaatctacccattagcgggggataacagttggaaacgactgctaataccgcatacgacattttctggcatcagagaatgttaaaaggtccgtttggaccactaatggatgagggtgcggcgtattagttagttggtggggtaatggcctaccaagacaatgatacgtagccgaactgagaggttgaacggccacatcgggactgagacacggcccgaactcctacgggaggcagcagtagggaatttttcacaatgggcgaaagcctgatggagcaatgccgcgtgactgaagacggtcttcggattgtaaaggtctgttgtaagggaagaacagtaagtataggaaatgatacttatttgacggtaccttaccagaaagccacggctaactatgtgccagcagccgcggtaatacataggtggcaagcgttatccggatttattgggcgtaaagcgtgcgcagacggtttaacaagtttggggtcaaattctggagcttaactccagttcgccttgaaaactgttaagctagagtgtaggagaggtcgatggaattccatgtgtagcggtgaaatgcgtagatatatggaggaacaccagtggcgaaggcggtcgactggcctatcactgacgtttaggcacgaaagcgtagggagcaaataggattagataccctagtagtctacgccgtaaacgatgagtactaagtgtcggactaagttcggtgctgcagctaacgcattaagtactccgcctgagtagtatgctcgcaagagtgaaactcaaaggaattgacggggacccgcacaagcggtggagcatgtggtttaattcgaagcaacgcgaagaaccttaccaaggcttgacatccagtgcaaagctgtagaaatacagtggaggttaacattgagacaggtggtgcatggttgtcgtcagctcgtgccgtgaggtgtttggttaagtccagtaacgagcgcaacccttgccgttagttactccattaagttgagatactctaacgggactgctagtgtaagctagaggaaggtggggatgacgtcaaatcatcatgccccttatgtcttgggctacacacgtgctacaatggccggtacaaacagttgcgatctcgtaagagggagctaatctgaaaaagccggtctcagttcggattgagggctgcaactcgccctcataaagccggaatcgctagtaatcgcgaatcagcaatgtcgcggtgaatacgttctcgggtcttgtacacaccgcccgtcacaccatgagagttgataataccagaagtcggtattctaaccgtaaggaggaagccgcccaaggtaggattgatgattagggtgaagtcgtaacaaggtatccgtacgagaacgtgcggctggatcacctcctt

SEQ ID NO: 1751 - DNA, 1506 bp, Sporobacter termitidis
  modified_base (361)..(361): a, c, t, g, unknown or other
  modified_base (361)..(361): a, c, t, g, unknown or other
  modified_base (377)..(377): a, c, t, g, unknown or other
  modified_base (377)..(377): a, c, t, g, unknown or other
  modified_base (863)..(863): a, c, t, g, unknown or other
  modified_base (863)..(863): a, c, t, g, unknown or other
  modified_base (1094)..(1094): a, c, t, g, unknown or other
  modified_base (1094)..(1094): a, c, t, g, unknown or other
  modified_base (1104)..(1104): a, c, t, g, unknown or other
  modified_base (1104)..(1104): a, c, t, g, unknown or other
  modified_base (1110)..(1110): a, c, t, g, unknown or other
  modified_base (1110)..(1110): a, c, t, g, unknown or other
agagtttgatcctggctcaggacgaacgctggcggcgtgcctaacacatgcaagtcgaacggagacaattggttcgctgattgtcttagtggcggacgggtgagtaacgcgtgagcaatctgcccttcggagggggacaacagctggaaacggctgctaataccgcataatgtatattcaaggcatcttggatataccaaagatttatcgccgaaggatgagctcgcgtctgattagctagttggtgaggtaaaggctcaccaaggctgcgatcagtagccggactgagaggttgaacggccacattggaactgagatacgggccagactcctacgggagggagcagtggggaattttggncaatgggggaaagccntacccagcaacgccgcgtgaaggaagaaggccttcgggttgtaaacttctttgaccagggacgaaacaaatgacggtacctggaaaacaagccacggctaactacgtgccagcagccgcggtattacgtaggtggcaagcgttgtccggatttactgggtgtaaagggcgcgtaggcgggagtacaagtcagatgtgaaatctgggggcttaaccctcaaactgcatttgaaactgtatttcttgagtatcggagaggcaggcggaattcctagtgtagcggtgaaatgcgttgatattaggaggaacaccagtggcgaaggcggcctgctggacgacaactgactctgaggcgcgaaagcgtggggagcaaacaggattagataccctggtagtccacgctgtaaacgatgaatactaggtgtggggggactgaccccctccgtgccggagttaacacaataagtattccacctggggagtacgnccgcaaggttgaaactcaaaggaattgacgggggcccgcacaagcagtggattatgtggtttaattcgaagcaacgcgaagaaccttaccagggcttgacatcgtactaacgaagcagagatgcattaggtgcccttccggggaaagtatagacaggtggtgcatggttgtcgtcagctcgtgtcgtgagatgttgggttaagtcccgcaacgagcgcaacccctattgtnatttgctacncgagancactctagcgaggctgccgatgacaaaccggaggaaggtggggacgacgtcaaatcatcatgccccttatgtcctgggctacacacgtaatacaatgtctctcacagagggaagcaagaccgcgaggtggagcaaatccctaaaatgcgtctcagttcagattgcaggctgcaactcgcctgcatgaagtcggaattgctagtaatcgcggatcagcatgccgcggtgaatacgttcccgggccttgtacacaccgcccgtcacaccatgagagccgggaacacccgaagtccgtagtctaaccgcaagggggacgcggccgaaggtgggtttggtaattggggtgaagtcgtaacaaggtagccgtatcggaaggtgcggctggatcacctcctt

SEQ ID NO: 1752 - DNA, 1503 bp, Sporolactobacillus inulinus
  modified_base (62)..(62): a, c, t, g, unknown or other
  modified_base (62)..(62): a, c, t, g, unknown or other
  modified_base (174)..(174): a, c, t, g, unknown or other
  modified_base (174)..(174): a, c, t, g, unknown or other
  modified_base (243)..(243): a, c, t, g, unknown or other
  modified_base (243)..(243): a, c, t, g, unknown or other
gacgaacgctggcggcgtgcctaatacatgcaagtcgagcgcacagaagggagcttgctccnggacgtgagcggcggatgggtgagtaacacgtgggcaacctgcctgtaagacggggataacttcgggaaaccggagctaataccggataatccctcgcaccgcatggtgcgnggttgaaagatggtttcggccatcacttacagatgggcccgcggtgcattagttagttggcggggtaanggcccaccaagaccgcgatgcatagccgacctgagagggtgatcggccacattgggactgagacacggcccaaactcctacgggaggcagcagtagggaatcttccacaatggacgaaagtctgatggagcaacgccgcgtgagcgaagaaggttttcggatcgtaaagctctgttgccggagaagaacgagtgccagaggaaatgctggtgctgtgacggtatccggccagaaagccacggctaactacgtgccagcagccgcggtaatacgtaggtggcaagcgttgtccggaattattgggcgtaaagcgcgcgcaggcggcttcttaagtctgatgtgaaatcttgcggctcaaccgcaaaaggtcattggaaactggggagcttgagtgcagaagaggagagtagaattccacgtgtagcggtgaaatgcgtagagatgtggaggaataccagtggcgaaggcggctctctggtctgttactgacgctgaggtgcgaaagcatggggagcaaacaggattagataccctggtagtccatgccgtaaacgatgaatgctaggtgttaggggggtccaaccccttagtgctgaagttaacacattaagcattccgcctggggagtacgaccgcaaggttgaaactcaaaggaattgacgggggcccgcacaagcagtggagcatgtggtttaattcgaagcaacgcgaagaaccttaccaggtcttgacatcctctgacaagtctagagataggccgttccccttcgggggacagagtgacaggtggtgcatggttgtcgtcagctcgtgtcgtgagatgttgggttaagtcccgcaacgagcgcaacccttgatcttagttgccagcattaagttgggcactctaaggtgactgccggtgacaaaccggaggaaggtggggatgacgtcaaatcatcatgccccttatgatctgggctacacacgtgctacaatgggcggtacaaagggcagcgaaaccgcaaggtcaagccaatcccataaagccgcccccagttcggattgcaggctgcaactcgcctgcatgaagccggaattgctagtaatcgcggatcagcatgccgcggtgaatccgttcccgggccttgtacacaccgcccgtcacaccacgagagtttgtaacacccgaagtcggtgtgggaacctttatggacccagccgccgaaggtgggacaaatgattggggtgaagtcgtaacaaggtagccgtatcggaagg

SEQ ID NO: 1753 - DNA, 1518 bp, Sporolactobacillus nakayamae
tttcctggctcaggacgaacgctggcggcgtgcctaatacatgcaagtcgagcgcattgaagggagcttgctcccggatgtgagcggcggatgggtgagtaacacgtgggtaacctgcctgtcagattgggataactgtgggaaaccgcagctaataccgaatgatcccctgcaccacatggtgcagggttgaaagatggtttcggccatcactgacagatgggcccgcggtgcattagttagttggcggggtaacggcccaccaagacagcgatgcatagccgacctgagagggtgatcggccacattgggactgagacacggcccaaactcctacgggaggcagcagtagggaatcttccacaatggacgaaagtctgatggagcaacgccgcgtgagcgaagaaggttttcggatcgtaaagctctgttgccggagaagaatgagtatgagaggaaatgcttgtactgtgacggtatccggccagaaagccacggctaactacgtgccagcagccgcggtaatacgtaggtggcaagcgttgtccggaattattgggcgtaaagcgcgcgcaggcggcttcttaagtctgatgtgaaatcttgcggctcaaccgcaaatggtcattggaaactgggaagcttgagtgcagaagaggagagtagaattccacgtgtagcggtgaaatgcgtagatatgtggaggaataccagtggcgaaggcggctctctggtctgtaactgacgctgaggcgcgaaagcgtggggagcaaacaggattagataccctggtagtccacgccgtaaacgatgaatgctaggtgttagggggtccaacccttagtgctgaagttaacacattaagcattccgcctggggagtacgaccgcaaggttgaaactcaaaggaattgacgggggcccgcacaagcagtggagcatgtggtttaattcgaagcaacgcgaagaaccttaccaggtcttgacatcctctgacaagtctagagataggccgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgatctgggctacacacgtgctacaatgggtggtacaaagggcagcgaaaccgcgaggtcaagcgaatcccataaagccacccccagttcggattgcaggctgcaactcgcctgcatgaagccggaattgctagtaatcgcggatcagcatgccgcggtgaatccgttcccgggccttgtacacaccgcccgtcacaccacgagagtttgtaacacccgaagtcggtgcgagaacctttatgggctcagccgccgaaggtgggacagatgattggggtgaagtcgtaacaaggtagccgtatcggaaggtgcg

SEQ ID NO: 1754 - DNA, 1539 bp, Sporosarcina newyorkensis
agagtttgatcctggctcaggacgaacgctggcggcgtgcctaatacatgcaagtcgagcgaatctttgggagcttgctcccaaagattagcggcggacgggtgagtaacacgtgggcaacctaccttacagatggggataactccgggaaaccggggctaataccgaataatccatttcttcgcatgaagagatgttgaaagacggtttcggctgtcactgtgagatgggcccgcggcgcattagttagttggtggggtaacggcctaccaagaccacgatgcgtagccgacctgagagggtgatcggccacactgggactgagacacggcccagactcctacgggaggcagcagtagggaatcttccacaatggacgaaagtctgatggagcaacgccgcgtgagtgaagaaggttttcggatcgtaaagctctgttgtaagggaagaacacgtacaggagtaactgcctgtaccttgacggtaccttaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactggaggacttgagtacagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacggggacccgcacaagcggtggagcatgtggtttaattcgaagcaacgcgaagaaccttaccaggtcttgacatcccgctgcccggcatggagacatgctttcccttcggggacagcggtgacaggtggtgcatggttgtcgtcagctcgtgtcgtgagatgttgggttaagtcccgcaacgagcgcaacccttaatcttagttgccatcattcagttgggcactctaaggtgactgccggtgacaaaccggaggaaggtggggatgacgtcaaatcatcatgccccttatgacctgggctacacacgtgctacaatggacggtacagagggctgcaaacccgcgagggggagccaatcccacaaaaccgttcccagttcggattgcaggctgcaactcgcctgcatgaagccggaatcgctagtaatcgtggatcagcatgccacggtgaatacgttcccgggtcttgtacacaccgcccgtcacaccacgagagtttgtaacacccgaagtcggtggggtaacccttacgggagccagccgccgaaggtgggacagatgattggggtgaagtcgtaacaaggtagccgtatcggaaggtgcggctggatcacct

SEQ ID NO: 1755 - DNA, 1474 bp, Sporosarcina sp.
  2681
gacgaacgctggcggcgtgcctaatacatgcaagtcgagcgratcttygggagcttgctccyraagrttagcggcggacgggtgagtaacacgtgggcaacctaccttacagatggggataactccgggaaaccggggctaataccgaataatccatytcttcgcatgragagatgttgaaagacggtttcggctgtcactgtgagatgggcccgcggcgcattagttagttggtggggtaacggcctaccaagaccacgatgcgtagccgacctgagagggtgatcggccacactgggactgagacacggcccagactcctacgggaggcagcagtagggaatcttccacaatggacgaaagtctgatggagcaacgccgcgtgagtgaagaaggttttcggatcgtaaagctctgttgtaagggaagaacacgtacaggagtaactgcctgtaccttgacggtaccttaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactggaggacttgagtacagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacggggacccgcacaagcggtggagcatgtggtttaattcgaagcaacgcgaagaaccttaccaggtcttgacatcccgctgcccggcatggagacatgcytttcccttcggggacagcggtgacaggtggtgcatggttgtcgtcagctcgtgtcgtgagatgttgggttaagtcccgcaacgagcgcaacccttaatcttagttgccatcattyagttgggcactctaaggtgactgccggtgacaaaccggaggaaggtggggatgacgtcaaatcatcatgccccttatgacctgggctacacacgtgctacaatggacggtacagagggctgcaaacccgcgagggggagccaatcccacaaaaccgttcccagttcggattgcaggctgcaactcgcctgcatgaagccggaatcgctagtaatcgtggatcagcatgccacggtgaatacgttcccgggtcttgtacacaccgcccgtcacaccacgagagtttgtaacacccgaagtcggtggggtaacccttacgggagccagccgccgaaggtgggacagatgattggggtg

SEQ ID NO: 1756 - DNA, 1509 bp, Staphylococcaceae bacterium NML 92-0017
gatgaacgctggcggcgtgcctaatacatgcaagtcgagcgcgactgattacaccgtycttcggracaccgtaatcatcgagcggcggacgggtgagtaacacgtgggcaacctacccttaagactgggataaccgcgggaaaccgtggctaataccggataatacttttatacaacggtatagaagttgaaaggtggatttctatcacttaaggatgggcctgcggcgcattagctggttggtaaggtaacggcttaccaaggcgacgatgcgtagccgacctgagagggtgatcggccacactggaactgagacacggtccagactcctacgggaggcagcagtagggaatcttccgcaatgggcgaaagcctgacggagcaacgccgcgtgtgcgaagaaggtcttcggatcgtaaagcactgttgttaaggaagaacgacagtaagagtaactgyttactgtgtgacggtacttaaccagaaagccacggctaactacgtgccagcagccgcggtaatacgtaggtggcaagcgttatccggaattattgggcgtaaagcgcgcgtaggcggcgagattagtctgatgtgaaagcccccggctcaaccggggaaggtcattggaaactgtttcgcttgagtgcagaagaggagagtggaattccatgtgtagcggtgaaatgcgcagagatatggaggaacaccagtggcgaaggcggctctctggtctgcaactgacgctgatgtgcgaaagcgtggggatcaaacaggattagataccctggtagtccacgccgtaaacgatgagtgctaagtgttagggggtttccgccccttagtgctgcagcaaacgcattaagcactccgcctggggagtacggccgcaaggctgaaactcaaaggaattgacggggacccgcacaagcggtggagcatgtggtttaattcgaagcaacgcgaagaaccttaccaaatcttgacatcctctgaccgtcatggagacatgattttccctttgggacagagagacaggtggtgcatggttgtcgtcagctcgtgtcgtgagatgttgggttaagtcccgcaacgagcgcaacccttaactttagttgccatcattcagttgggcactctagagtgactgccggtgacaaaccggaggaaggtggggatgacgtcaaatcatcatgccccttatgatttgggcgacacacgtgctacaatggacaggaacaaagggcagcgaaactgtgaagtcaagcgaatcccataaaactgttctcagttcggattggagtctgcaactcgactccatgaagctggaatcgctagtaatcgtggatcagaatgccacggtgaatacgttcccgggtcttgtacacaccgcccgtcacaccacgaaagttggtaacacctgaagccggtggcctaaccatttggagggagccgtcgaaggtgggaccgatgattggggtgaagtcgtaacaaggtagccgtatcggaagg

SEQ ID NO: 1757 - DNA, 1401 bp, Staphylococcus aureus
  modified_base (48)..(48): a, c, t, g, unknown or other
  modified_base (48)..(48): a, c, t, g, unknown or other
  modified_base (1392)..(1392): a, c, t, g, unknown or other
  modified_base (1392)..(1392): a, c, t, g, unknown or other
agcgaacggacgagaagcttgcttctctgatgttagcggcggacgggngagtaacacgtggataacctacctataagactgggataacttcgggaaaccggagctaataccggataatattttgaaccgcatggttcaaaagtgaaagacggtcttgctgtcacttatagatggatccgcgctgcattagctagttggtaaggtaacggcttaccaaggcaacgatgcatagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacatatgtgtaagtaactgtgcacatcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaacttaccaaatcttgacatcctttgaccactctagagatagagccttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtanccttttagg

SEQ ID NO: 1758 - DNA, 1410 bp, Staphylococcus auricularis
tcgagcgaacagataaggagcttgctcctttgacgttagcggcggacgggtgagtaacacgtgggtaacctacctataagactggaataactccgggaaaccggggctaatgccggataacatgttgaaccgcatggttctacagtgaaaggcggctttgctgtcacttatagatggacccgcgccgtattagctagttggtgaggtaacggctcaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaatgcgtaagtaactgtgcgcgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactgaaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttaggggggtttccgccccttagtgctgcagctaacgcattamgcactccgcctggggagtacggccgcaaggcttaaactcaaaggaattgacggggacccgcacaagcggtggagcatgtggtttaaattcgaagcaacgcgaagaaccttaccaaatcttgacatcctttgaccgctctagagatagagtcttccccttcgggggacaaagtgacaggtggtgcatggttgtcgtcagctcgtgtcgtgagatgttgggttaagtcccgcaacgagcgcaacccttaagcttagttgccatcattcagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagtcggtagagtaaccttttggagcta

SEQ ID NO: 1759 - DNA, 1549 bp, Staphylococcus capitis
tggagagtttgatcctggctcaggatgaacgctggcggcgtgcctaatacatgcaagtcgagcgaacagacgaggagcttgctcctctgacgttagcggcggacgggtgagtaacacgtggataacctacctataagactgggataacttcgggaaaccggagctaataccggataacatgttgaaccgcatggttcaacagtgaaagacggtcttgctgtcacttatagatggatccgcgccgcattagctagttggtaaggtaacggcttaccaaggcaacgatgcgtagccgacctgagagggtgatcggccacactggaactgagacacggtccagactcctacgggaggcagcagtagggaatcttccgcaatgggcgaaagcctgacggagcaacgccgcgtgagtgaagaaggtcttcggatcgtaaaactctgttattagggaagaacaaatgtgtaagtaactatgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctctgacccctctagagatagagttttccccttcgggggacagagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggtagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccttttggagctagccgtcgaaggtgggacaaatgattggggtgaagtcgtaacaaggtagccgtatcggaaggtgcggctggatcacctcctttct

SEQ ID NO: 1760 - DNA, 1551 bp, Staphylococcus caprae
tggagagtttgatcctggctcaggatgaacgctggcggcgtgcctaatacatgcaagtcgagcgaacagacgaggagcttgctcctttgacgttagcggcggacgggtgagtaacacgtggataacctacctataagactgggataacttcgggaaaccggagctaataccggataacatgttgaaccgcatggttcaacagtgaaagacggtcttgctgtcacttatagatggatccgcgccgcattagctagttggtaaggtaacggcttaccaaggcaacgatgcgtagccgacctgagagggtgatcggccacactggaactgagacacggtccagactcctacgggaggcagcagtagggaatcttccgcaatgggcgaaagcctgacggagcaacgccgcgtgagtgaagaaggtcttcggatcgtaaaactctgttattagggaagaacaaatgtgtaagtaactatgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctctgatcccctctagagatagagttttccccttcgggggacagagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggtagcgaaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccttttggagctagccgtcgaaggtgggacaaatgattggggtgaagtcgtaacaaggtagccgtatcggaaggtgcggctggatcacctcctttct

SEQ ID NO: 1761 - DNA, 1555 bp, Staphylococcus carnosus
ttttatggagagtttgatcctggctcaggatgaacgctggcggcgtgcctaatacatgcaagtcgagcgaacagacgaggagcttgctcctctgacgttagcggcggacgggtgagtaacacgtgggtaacctacctataagactggaataactccgggaaaccggggctaatgccggataatatgcagaaccgcatggttctgcaatgaaagacggttttgctgtcacttatagatggacccgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaagtgcgtaggtaactatgcgcaccttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgcaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacggggacccgcacaagcggtggagcatgtggtttaattcgaagcaacgcgaagaaccttaccaaatcttgacatcctttgaccgctctagagatagagtcttccccttcgggggacaaagtgacaggtggtgcatggttgtcgtcagctcgtgtcgtgagatgttgggttaagtcccgcaacgagcgcaacccttaagcttagttgccagcattaagttgggcactctaagttgactgccggtgacaaaccggaggaaggtggggatgacgtcaaatcatcatgccccttatgatttgggctacacacgtgctacaatggacagtacaaagggcagcgaaaccgcgaggtcaagcaaatcccataaagctgttctcagttcggattgtagtctgcaactcgactacatgaagctggaatcgctagtaatcgtagatcagcatgctacggtgaatacgttcccgggtcttgtacacaccgcccgtcacaccacgagagttcgtaacacccgaagccggtggagtaaccttttaggagctagccgtcgaaggtgggacgaatgattggggtgaagtcgtaacaaggtagccgtatcggaaggtgcggctggatcacctcctttct

SEQ ID NO: 1762 - DNA, 1232 bp, Staphylococcus cohnii
gcaagtcgagcgagcggcggacgggtgagtaacacgtgggtaacctacctataagactggaataactccgggaaaccggggctaatgccggataacgaaagttacttatagatggacccgcgccgtattagctagttggtaaggtaacggcttaccaaggcaacgaaacgtagccgacctgagagggggatcgtccacactggaactgagacacggtccagactcctaccggaggcagcagtagggaatcttccgcaatgggcgaaagcctgacggagcaacgccgcgtgagtgatgaaggtcttcggatcgtaaaactctgttattagggaagatgacggtacctaatcagaaagccacggctaactacgtgccagcagccgcggtaatacgtaggtggcaagcgttatccggaattattgggcgtaaagcgcgcgtaggcggtttcttaagtctgatgtgaaagcccacggctcaaccgtggagggtcattggaaactgggaaacttgagtgcagaagaggaaagtggaattccatgtgtagcggtgaaatgcgcagagatatggaggaacaccagtggcgaaggcgactttctggtctgactgacgctgatgtgcgaaagcgtggggatcaaacaggattagataccctggtagtccacgccgtaaacgatgagtgctaagtgttagggccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcgacaggtggtgcatggttgtcgtcagctcgtgtcgtgagatgttgggttaagtcccgcaacgagcgcaacccttaaacttagttgccagcatgggcactctaagttgactgccggtgacaaaccggaggaaggtggggatgacgtcaaatcatcatgccccttatgatttgggctacacacgtgctacaatggacaacaaagggcagctaaaccgcgaggtcatgcaaatcccatttgttctcagttcggatgtagtctgcaactcgactacagaagctggaatcgctagtaatcgtagatcagcatgctacggtgaatacgttcccgggtcttgtacacaccgcccgtcacaccacgagagtttgtaacacccgaagccggtgagtag

SEQ ID NO: 1763 - DNA, 1545 bp, Staphylococcus condimenti
  modified_base (11)..(12): a, c, t, g, unknown or other
  modified_base (11)..(12): a, c, t, g, unknown or other
agagtttgatnntggctcaggatgaacgctggcggcgtgcctaatacatgcaagtcgagcgaacagatgaggagcttgctcctctgacgttagcggcggacgggtgagtaacacgtgggtaacctacctataagactggaataactccgggaaaccggggctaatgccggataatatgcggaaccgcatggttctgcaatgaaagacggttttgctgtcacttatagatggacccgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaagtgcgtaggtaactatgcgcaccttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgcaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacggggacccgcacaagcggtggagcatgtggtttaattcgaagcaacgcgaagaaccttaccaaatcttgacatcctttgaccgctctagagatagagtcttccccttcgggggacaaagtgacaggtggtgcatggttgtcgtcagctcgtgtcgtgagatgttgggttaagtcccgcaacgagcgcaacccttaagcttagttgccagcattaagttgggcactctaagttgactgccggtgacaaaccggaggaaggtggggatgacgtcaaatcatcatgccccttatgatttgggctacacacgtgctacaatggacagtacaaagggcagcgaaaccgcgaggtcaagcaaatcccataaagctgttctcagttcggattgtagtctgcaactcgactacatgaagctggaatcgctagtaatcgtagatcagcatgctacggtgaatacgttcccgggtcttgtacacaccgcccgtcacaccacgagagttcgtaacacccgaagccggtggagtaaccttttaggagctagccgtcgaaggtgggacgaatgattggggtgaagtcgtaacaaggtagccgtatcggaaggtgcggctggatcacctccttt

SEQ ID NO: 1764 - DNA, 1395 bp, Staphylococcus epidermidis
tcgagcgaacagacgaggagcttgctcctctgacgttagcggcggacgggtgagtaacacgtggataacctacctataagactgggataacttcgggaaaccggagctaataccggataatatattgaaccgcatggttcaatagtgaaagacggttttgctgtcacttatagatggatccgcgccgcattagctagttggtaaggtaacggcttaccaaggcaacgatgcgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaatgtgtaagtaactatgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaagcttaccaaatcttgacatcctctgacccctctagagatagagttttccccttcgggggacagagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactatatgaagctggaatcgctagtaatcgtagatcagcatgctacggtgaatacgttcccgggtcttgtacacaccgcccgtcacaccacgagagtttgtaacacccgaagccggtggagtaa

SEQ ID NO: 1765 - DNA, 1494 bp, Staphylococcus equorum
agagtttgatcctggctcaggatgaacgctggcggcgtgcctaatacatgcaagtcgagcgaacggataaggagcttgctcctttgaagttagcggcggacgggtgagtaacacgtgggtaacctacctataagactggaataacttcgggaaaccggagctaatgccggataacatttggaaccgcatggttctaaagtaaaagatggttttgctatcacttatagatggacccgcgccgtattagctagttggtaaggtaacggcttaccaaggcaacgatacgtagccgacctgagagggtgatcggccacactggaactgagacacggtccagactcctacgggaggcagcagtagggaatcttccgcaatggacgaaagtctgacggagcaacgccgcgtgagtgatgaaggttttcggatcgtaaaactctgttattagggaagaacaaatgtgtaagtaactgtgcacatcttgacggtacctaatcagaaagccacggctaactacgtgccagcagccgcggtaatacgtaggtggcaagcgttatccggaattattgggcgtaaagcgcgcgtaggcggtttcttaagtctgatgtgaaagcccacggctcaaccgtggagggtcattggaaactgggaaacttgagtacagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgaaaactctagagatagagccttccccttcgggggacaaagtgacaggtggtgcatggttgtcgtcagctcgtgtcgtgagatgttgggttaagtcccgcaacgagcgcaacccttaaacttagttgccagcatttagttgggcactctaggttgactgccggtgacaaaccggaggaaggtggggatgacgtcaaatcatcatgccccttatgatttgggctacacacgtgctacaatggacaatacaaagggcagctaaaccgcgaggtcatgcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttatggagctagccgtcgaaggtgggacaaatgattggggt

SEQ ID NO: 1766 - DNA, 1454 bp, Staphylococcus fleurettii
agctggcggcgtgcctaatacatgcaagtcgagcgaacagatgagaagcttgcttctctgatgttagcggcggacgggtgagtaacacgtgggtaacctacctataagactgggataactccgggaaaccggggctaatacctgataatattttgaaccgcatggttcgatagtgaaaggcggcttcggctgtcacttatagatggacccgcgccgtattagctagttggtaaggtaatggcttaccaaggcgacgatacgtagccgacctgagagggtgatcggccacactggaactgagacacggtccagactcctacgggaggcagcagtagggaatcttccgcaatgggcgaaagcctgacggagcaacgccgcgtgagtgatgaaggttttcggatcgtaaaactctgttgttagggaagaacaaatttgttagtaactgaacaagtcttgacggtacctaaccagaaagccacggctaactacgtgccagcagccgcggtaatacgtaggtggcaagcgttatccggaattattgggcgtaaagcgcgcgtaggcggtttcttaagtctgatgtgaaagcccacggctcaaccgtggagggtcattggaaactggggaacttgagtgcagaagaggagagtggaattccatgtgtagcggtgaaatgcgcagagatatggaggaacaccagtggcgaaggcggctctctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgatcgctctagagatagagtcttccccttcgggggacaaagtgacaggtggtgcatggttgtcgtcagctcgtgtcgtgagatgttgggttaagtcccgcaacgagcgcaacccttaagcttagttgccatcattaagttgggcactctaggttgactgccggtgacaaaccggaggaaggtggggatgacgtcaaatcatcatgccccttatgatttgggctacacacgtgctacaatggataatacaaagggcagcgaacccgcgaggtcaagcaaatcccataaaattattctcagttcggattgtagtctgcaactcgactacatgaagctggaatcgctagtaatcgtagatcagcatgctacggtgaatacgttcccgggtcttgtgaacaccgcccgtcacaccacgagagtctgtaacacccgaaagccggtggagtaaccttttattaggagctagccgtcgaaggt

SEQ ID NO: 1767 - DNA, 1549 bp, Staphylococcus haemolyticus
tggagagtttgatcctggctcaggatgaacgctggcggcgtgcctaatacatgcaagtcgagcgaacagacaaggagcttgctcctttgacgttagcggcggacgggtgagtgacacgtgggtaacctacctataagactgggataacttcgggaaaccggagctaataccggataatatttcgaaccgcatggttcgatagtgaaagatggttttgctatcacttatagatggacccgcgccgtattagctagttggtaaggtaacggcttaccaaggcgacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacatacgtgtaagtaactatgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacaactctagagatagagccttccccttcgggggacaaagtgacaggtggtgcatggttgtcgtcagctcgtgtcgtgagatgttgggttaagtcccgcaacgagcgcaacccttaagtttagttgccatcattaagttgggcactctaagttgactgccggtgacaaaccggaggaaggtggggatgacgtcaaatcatcatgccccttatgatttgggctacacacgtgctacaatggacaatacaaagggcagcgaaatcgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctggatcacctcctttct

SEQ ID NO: 1768 - DNA, 1575 bp, Staphylococcus hominis
  modified_base (1)..(1): a, c, t, g, unknown or other
  modified_base (1)..(1): a, c, t, g, unknown or other
ncgvtccagctccggccgccatggcggccgcgggaaattcgattagagtttgattatggctcaggatggacgctggcggcgtgcctaatacatgcaagtcgagcgaacagacgaggagcttgctccttcgacgttagcggcggacgggtgagtaacacgtaggtaacctacctataagactgggataacttcgggaaaccggagctaataccggataatatttcgaaccgcatggttcgatagtgaaagatggctttgctatcacttatagatggacctgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacccttctagagatagaagtttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaaccatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtaaccgtaaatcactagtgaattc

SEQ ID NO: 1769 - DNA, 970 bp, Staphylococcus lugdunensis
tcgagcgaacagatgaggagcttgctcctttgacgttagcggcggacgggtgagtaacacgtgggtaacctacctataagactgggacaacttcgggaaaccggagctaataccggataatatgttgaaccgcatggttcaatagtgaaagatggttttgctatcacttatagatggatccgcgccgtattagctagttggtgaggtaacggctcaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttaggatcgtaaaactctgttattagggaagaacaaacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaatcttgacatcctttgaccgctctagagatagagtct

SEQ ID NO: 1770 - DNA, 1520 bp, Staphylococcus pasteuri
ggagagtttgatcctggctcaggatgaacgctggcggcgtgcctaatacatgcaagtcgagcgaacagataaggagcttgctcctttgacgttagcggcggacgggtgagtaacacgtggataacctacctataagactgggataacttcgggaaaccggagctaataccggataacatattgaaccgcatggttcaatagtgaaaggcggctttgctgtcacttatagatggatccgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcagcgccgcgtgagtgatgaaggtcttcggatcgtaaaactctgttatcagggaagaacaaatgtgtaagtaactgtgcacatcttgacggtacctgatcagaaagccacggctaacaacgtgccagcagccgcggtaatacgtaggtggcaagcgttatccggaattattgggcgtaaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcacgccgcctggggagtacgaccgcaaggttgaaactcaaaggaattgacggggacccgcacaagcggtggagcatgtggtttaattcgaagcaacgcgaagaaccttaccaaatcttgacatcctttgaccgctctagagatagagtcttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagctaaaccgcgaggtcaagcaaatcccataaagttgttctcagttcggattgtagtctgcaactcgactacatgaagctggaatcgctagtaatcgtagaacagcatgctacggtgaatacgttcccgggtcttgtacacaccgcccgtcacaccacgagagtttgtaacacccgaagccggtggagtaaccatttatggagctagccgtcgaaggtgggacaaatgattggggtgaagtcgtaacaaggtagccgta

SEQ ID NO: 1771 - DNA, 1555 bp, Staphylococcus pseudintermedius
ttttatggagagtttgatcctggctcaggatgaacgctggcggcgtgcctaatacatgcaagtcgagcgaacagataaggagcttgctcctttgacgttagcggcggacgggtgagtaacacgtgggtaacctacctataagactggaataactccgggaaaccggggctaatgccggataacatgttgaaccgcatggttctacagtgaaagacggtcttgctgtcacttatagatggacccgcgccgtattagctagttggtggggtaacggcctaccaaggcgacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaagctctgttgttagggaagaacaaatgtgtaagtaactgtgcacatcttgacggtacctaaccagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcggctttctggtctgcaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacggggacccgcacaagcggtggagcatgtggtttaattcgaagcaacgcgaagaaccttaccaaatcttgacatcctttgaccgctctagagatagagttttcctcttcggaggacaaagtgacaggtggtgcatggttgtcgtcagctcgtgtcgtgagatgttgggttaagtcccgcaacgagcgcaacccttgagcttagttgccatcattcagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccattttggagctagccgtcgaaggtgggacaaatgattggggtgaagtcgtaacaaggtagccgtatcggaaggtgcggctggatcacctcctttct

SEQ ID NO: 1772 - DNA, 1527 bp, Staphylococcus saccharolyticus
  modified_base (22)..(22): a, c, t, g, unknown or other
  modified_base (22)..(22): a, c, t, g, unknown or other
  modified_base (1505)..(1505): a, c, t, g, unknown or other
  modified_base (1505)..(1505): a, c, t, g, unknown or other
ctggctcaggatgtaygctggnggcgtgcctaatacatgcaagtcgagcgaacagacgaggagcttgctcctctgacgttagcggcggacgggtgagtaacacgtggataacctacctataagactgggataacttcgggaaaccggagctaataccagataacatgttgaaccgcatggttcaacagtgaaagacggtcttgctgtcacttatagatggatccgcgccgcattagctagttggtaaggtaacggcttaccaaggcaacgatgcgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaatgtgtaagtaactatgcacgtcttgacggcacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctctgacccctctagagatagagttttccccttcgggggacagagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaaccccataaagttgttctcagttcggattgtagtctgcaactcgactatatgaagctggaatcgctagtaatcgtagatcagcatgctacggtgaatacgttcccgggtcttgtacacaccgcccgtcacaccacgagagtttgtaacacccgaagccggtggagtaacctkttggagctagccgtcgaaggtgggacaaatgattggggtgaagtcgtaacaaggtaagtcgtnacaaggtaagtcgccacaaggt

SEQ ID NO: 1773 - DNA, 1551 bp, Staphylococcus saprophyticus
tggagagtttgatcctggctcaggatgaacgctggcggcgtgcctaatacatgcaagtcgagcgaacagataaggagcttgctcctttgacgttagcggcggacgggtgagtaacacgtgggtaacctacctataagactgggataacttcgggaaaccggagctaataccggataacatttggaaccgcatggttctaaagtgaaagatggttttgctatcacttatagatggacccgcgccgtattagctagttggtaaggtaacggcttaccaaggcgacgatacgtagccgacctgagagggtgatcggccacactggaactgagacacggtccagactcctacgggaggcagcagtagggaatcttccgcaatgggcgaaagcctgacggagcaacgccgcgtgagtgatgaagggtttcggctcgtaaaactctgttattagggaagaacaaacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggtttcttaagtctgatgtgaaagcccacggctcaaccgtggagggtcattggaaactgggaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgaaaactctagagatagagccttccccttcgggggacaaagtgacaggtggtgcatggttgtcgtcagctcgtgtcgtgagatgttgggttaagtcccgcaacgagcgcaacccttaagcttagttgccatcattaagttgggcactctaggttgactgccggtgacaaaccggaggaaggtggggatgacgtcaaatcatcatgccccttatgatttgggctacacacgtgctacaatggacaatacaaagggcagctaaaccgcgaggtcatgcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttatggagctagccgtcgaaggtgggacaaatgattggggtgaagtcgtaacaaggtagccgtatcggaaggtgcggctggatcacctcctttct

SEQ ID NO: 1774 - DNA, 1528 bp, Staphylococcus sciuri
gatgaacgctggcggcgtgcctaatacatgcaagtcgagcgaacagatgagaagcttgcttctctgatgttagcggcggacgggtgagtaacacgtgggtaacctacctataagactgggataactccgggaaaccggggctaataccggataatattttgaaccgcatggttcaatagtgaaagacggtttcggctgtcacttatagatggacccgcgccgtattagctagttggtaaggtaacggcttaccaaggcgacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttgttagggaagaacaaatttgttagtaactgaacaagtcttgacggtacctaaccagaaagccacggctaactacgtgccagcagccgcggtaatacgtaggtggcaagcgttatccggaattattgggcgtaaagcgcgcgtaggcggtttcttaagtctgatgtgaaagcccacggctcaaccgtggagggtcattggaaactgggaaacttgagtgcagaagaggagagtggaattccatgtgtagcggtgaaatgcgcagagatatggaggaacaccagtggcgaaggcggctctctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgaccgctctagagatagagtcttccccttcgggggacaaagtgacaggtggtgcatggttgtcgtcagctcgtgtcgtgagatgttgggttaagtcccgcaacgagcgcaacccttaagcttagttgccatcattaagttgggcactctaggttgactgccggtgacaaaccggaggaaggtggggatgacgtcaaatcatcatgccccttatgatttgggctacacacgtgctacaatggataatacaaagggcagcgaatccgcgaggccaagcaaatcccataaaattattctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccttttaggagctagccgtcgaaggtgggacaaatgattggggtgaagtcgtaacaaggtagccgtatcggaaggtgcggctggatcacctcctttct

SEQ ID NO: 1775 - DNA, 1364 bp, Staphylococcus sp.
  H292
gagtttgatcctggctcaggatgaacgctggcggcgtgcctaatacatgcaagtcgagcgagcggcggacgggtgagtaacacgtaggtaacctacctataagactgggataacttcgggaaaccggagctaataccggataatgaaagtcacttatagatggacctgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagatgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgactgacgctgatgtgcgaaagcgtggggatcaaacaggattagataccctggtagtccacgccgtaaacgatgagtgctaagtgttagggccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcgacaggtggtgcatggttgtcgtcagctcgtgtcgtgagatgttgggttaagtcccgcaacgagcgcaacccttaagcttagttgccatcatgggcactctaagttgactgccggtgacaaaccggaggaaggtggggatgacgtcaaatcatcatgccccttatgatttgggctacacacgtgctacaatggacaacaaagggcagcgaaaccgcgaggtcaagcaaatcccatttgttctcagttcggatgtagtctgcaactcgactacagaagctggaatcgctagtaatcgtagatcagcatgctacggtgaatacgttcccgggtcttgtacacaccgcccgtcacaccacgagagtttgtaacacccgaagccggtgagtagctagccgtcgaaggtgggacaaatgattggggtgaagtcgtaacaaggtagccgtatcggaaggtgcggctggatcacctcctt

SEQ ID NO: 1776 - DNA, 1364 bp, Staphylococcus sp.
  H780
gagtttgatcctggctcaggatgaacgctggcggcgtgcctaatacatgcaagtcgagcgagcggcggacgggtgagtaacacgtggataacctacctataagactgggataacttcgggaaaccggagctaataccggataatgaaagtcacttatagatggatccgcgccgcattagctagttggtaaggtaacggcttaccaaggcaacgatgcgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagatgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgactgacgctgatgtgcgaaagcgtggggatcaaacaggattagataccctggtagtccacgccgtaaacgatgagtgctaagtgttagggccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcgacaggtggtgcatggttgtcgtcagctcgtgtcgtgagatgttgggttaagtcccgcaacgagcgcaacccttaagcttagttgccatcatgggcactctaagttgactgccggtgacaaaccggaggaaggtggggatgacgtcaaatcatcatgccccttatgatttgggctacacacgtgctacaatggacaacaaagggcagcgaaaccgcgaggtcaagcaaatcccatttgttctcagttcggatgtagtctgcaactcgactatagaagctggaatcgctagtaatcgtagatcagcatgctacggtgaatacgttcccgggtcttgtacacaccgcccgtcacaccacgagagtttgtaacacccgaagccggtgagtagctagccgtcgaaggtgggacaaatgattggggtgaagtcgtaacaaggtagccgtatcggaaggtgcggctggatcacctcctt

SEQ ID NO: 1777 - DNA, 1545 bp, Staphylococcus sp.
  clone bottae7
gagtttgatcctggctcaggatgaacgctggcggcgtgcctaatacatgcaagtcgagcgaacagataaggagcttgctcctttgacgttagcggcggacgggtgagtaacacgtgggtaacctacctataagactgggataactccgggaaaccggggctaataccggataatatttagaaccgcatggttctaaagtgaaagatggccttgctatcacttatagatggacccgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttactagggaagaacaaatgcgtaagtaactgtgcgcgtcttgacggtacctaatcagaaagccacggctaactacgtgccagcagccgcggtaatacgtaggtggcaagcgttatccggaattattgggcgtaaagcgcgcgtaggcgggtttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgctgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgaccacgctagagatagcgttttccccttcgggggacaaagtgacaggtggtgcatggttgtcgtcagctcgtgtcgtgagatgttgggttaagtcccgcaacgagcgcaacccttaagcttagttgccatcattaagttgggcactctaggttgactgccggtgacaaaccggaggaaggtggggatgacgtcaaatcatcatgccccttatgatttgggctacacacgtgctacaatggacaatacaaagggcagctaaaccgcgaggtcatgcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccttttggagctagccgtcgaaggtgggacaaatgattggggtgaagtcgtaacaaggtagccgtatcggaaggtgcggctggatcacctcctttct

SEQ ID NO: 1778 - DNA, 1548 bp, Staphylococcus succinus
tggagagtttgatcctggctcaggatgaacgctggcggcgtgcctaatacatgcaagtcgagcgaacggataaggagcttgctcctttgaagttagcggcggacgggtgagtaacacgtgggtaacctacctataagactggaataacttcgggaaaccggagctaatgccggataacatatagaaccgcatggttctatagtgaaagatggttttgctatcacttatagatggacccgcgccgtattagctagttggtaaggtaatggcttaccaaggcgacgatacgtagccgacctgagagggtgatcggccacactggaactgagacacggtccagactcctacgggaggcagcagtagggaatcttccgcaatgggcgaaagcctgacggagcaacgccgcgtgagtgatgaaggttttcggatcgtaaaactctgttattagggaagaacaaatgcgtaagtaactgtgcgcatcttgacggtacctaatcagaaagccacggctaactacgtgccagcagccgcggtaatacgtaggtggcaagcgttatccggaattattgggcgtaaagcgcgcgtaggcggtttcttaagtctgatgtgaaagcccacggctcaaccgtggagggtcattggaaactgggaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgaaaactctagagatagagccttccccttcgggggacaaagtgacaggtggtgcatggttgtcgtcagctcgtgtcgtgagatgttgggttaagtcccgcaacgagcgcaacccttaagcttagttgccatcattaagttgggcactctaggttgactgccggtgacaaaccggaggaaggtggggatgacgtcaaatcatcatgccccttatgatttgggctacacacgtgctacaatggacaatacaaagggcagctaaaccgcgaggtcatgcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttatggagctagccgtcgaaggtgggacaaatgattggggtgaagtcgtaacaaggtagccgtatcggaaggtgcggctggatcacctcctt

SEQ ID NO: 1779 - DNA, 1497 bp, Staphylococcus vitulinus
agagtttgatcctggctcaggacgaacgctggcggcgtgcctaatacatgcaagtcgagcgaacagatgagaagcttgcttctctgatgttagcggcggacgggtgagtaacacgtgggtaacctacctataagactgggataactccgggaaaccggggctaatacctgataatattttgaaccgcatggttcaatagtgaaagacggcttcggctgtcacttatagatggacccgcgccgtattagctagttggtaaggtaatggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttaggatcgtaaaactctgttgttagggaagaacaaatttgttagtaactgaacaagtcttgacggtacctaaccagaaagccacggctaactacgtgccagcagccgcggtaatacgtaggtggcaagcgttatccggaattattgggcgtaaagcgcgcgtaggcggtttcttaagtctgatgtgaaagtccacggctcaaccgtggaaggtcattggaaactggggaacttgagtgcagaagaggagagtggaattccatgtgtagcggtgaaatgcgcagagatatggaggaacaccagtggcgaaggcggctctctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgatcgctctagagatagagttttccccttcgggggacaaagtgacaggtggtgcatggttgtcgtcagctcgtgtcgtgagatgttgggttaagtcccgcaacgagcgcaacccttaagcttagttgccatcattaagttgggcactctaggttgactgccggtgacaaaccggaggaaggtggggatgacgtcaaatcatcatgccccttatgatttgggctacacacgtgctacaatggataatacaaagggcagcgaaaccgcgaggtcaagcaaatcccataaaattattctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccttttattaggagctagccgtcgaaggtgggacagatgattggggt

SEQ ID NO: 1780 - DNA, 1403 bp, Staphylococcus warneri
cgaacagataaggagcttgctcctttgacgttagcggcggacgggtgagtaacacgtggataacctacctataagactgggataacttcgggaaaccggagctaataccggataacatattgaaccgcatggttcaatagtgaaaggcggctttgctgtcacttatagatggatccgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttatcagggaagaacaaatgtgtaagtaactgtgcacatcttgacggtacctgatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggggagcatgtggtttaattcgaagcaacgcgaagaaccttacgaaatcatgacgtcctttgacgtttctagagatagagtcgtctacatcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagctaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttatggagct

SEQ ID NO: 1781 - DNA, 1487 bp, Staphylococcus xylosus
tggcggggtgcctaatacatgcaagtcgagcgaacagataaggagcttgctcctttgacgttagcggcggacgggtgagtaacacgtgggtaacctacctataagactgggataacttcgggaaaccggagctaataccggataacatttggaaccgcatggttctaaagtgaaagatggttttgctatcacttatagatggacccgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaagggtttcggctcgtaaaactctgttattagggaagaacaaatgtgtaagtaactgtgcacatcttgacggtacctaatcagaaagccacggctaactacgtgccagcagccgcggtaatacgtaggtggcaagcgttatccggaattattgggcgtaaagcgcgcgtaggcggtttcttaagtctgatgtgaaagcccacggctcaaccgtggagggtcattggaaactgggaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttaggtgggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgaaaactctagagatagagccttccccttcgggggacaaagtgacaggtggtgcatggttgtcgtcagctcgtgtcgtgagatgttgggttaagtcccgcaacgagcgcaacccttaagcttagttgccatcattaagttgggcactctaggttgactgccggtgacaaaccggaggaaggtggggatgacgtcaaatcatcatgccccttatgatttgggctacacaccgtgctacaatggacaatacaaagggcagctaaaccgcgaggtcatgcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttatggagctagccgtcgaaggtgggacaaatgattggggtgaagtcgtaacaagggaacc

SEQ ID NO: 1782 - DNA, 1547 bp, Stenotrophomonas maltophilia
taagtgaagagtttgatcctggctcagagtgaacgctggcggtaggcctaacacatgcaagtcgaacggcagcacagtaagagcttgctcttacgggtggcgagtggcggacgggtgaggaatacatcggaatctactttttcgtgggggataacgtagggaaacttacgctaataccgcatacgacctacgggtgaaagcaggggatcttcggaccttgcgcgattgaatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccataccgcgtgggtgaagaaggccttcgggttgtaaagcccttttgttgggaaagaaatccagctggttaatacccggttgggatgacggtacccaaagaataagcaccggctaacttcgtgccagcagccgcggtaatacgaagggtgcaagcgttactcggaattactgggcgtaaagcgtgcgtaggtggttgtttaagtctgttgtgaaagccctgggctcaacctgggaactgcagtggaaactggacgactagagtgtggtagagggtagcggaattcctggtgtagcagtgaaatgcgtagagatcaggaggaacatccatggcgaaggcagctacctggaccaacactgacactgaggcacgaaagcgtggggagcaaacaggattagataccctggtagtccacgccctaaacgatgcgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgcttgccacggtgtggccgatgactggggtgaagtcgtaacaaggtagccgtatcggaaggtgcggctggatcacctccttt

SEQ ID NO: 1783 - DNA, 1508 bp, Stenotrophomonas sp.
  FG-6
gtttgatcctggctcagagtgaacgctggcggtaggcctaacacatgcaagtcgaacggcagcacagtaagagcttgctcttacgggtggcgagtggcggacgggtgaggaatgcatcggaatctactctgtcgtgggggataacgtagggaagcttacgctaataccgcatacgacctacgggtgaaagcaggggatcttcggaccttgcgcgattgaatgagccgatgcccgattagctagttggcggggtaagagcccaccaaggcgacgatcggtagctggtctgagaggatgatcagccacactggaactgagacacggtccagactcctacgggaggcagcagtggggaatattggacaatgggcgcaagcctgatccagccataccgcgtgggtgaagaaggccttcgggttgtaaagcccttttgttgggaaagaaaagcagccggttaatacccggttgttctgacggtacccaaagaataagcaccggctaacttcgtgccagcagccgcggtaatacgaagggtgcaagcgttactcggaattactgggcgtaaagcgtgcgtaggtggttgtttaagtctgtcgtgaaagccctgggctcaacctgggaatggcgatggaaactgggcgactagagtgtggcagagggtagtggaattcctggtgtagcagtgaaatgcgtagagatcaggaggaacatccgtggcgaaggcgactgcctgggccaacactgacactgaggcacgaaagcgtggggagcaaacaggattagataccctggtagtccacgccctaaacgatgcgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgcacggaactttccagagatggattggtgccttcgggaaccgtgacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtgagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgcttgccacggtgtggccgatgactggggtgaagtcgtaacaaggtagccgta

SEQ ID NO: 1784 - DNA, 1485 bp, Streptobacillus moniliformis
agagtttgatcctggctcaggatgaacgctgacagaatgcttaacacatgcaaatctatgtatgaaatgtaagcttgcttacatagactacatggtggactggtgagtaacgtgtaaagaacttacctcttagactgggataaccattaggaaatgatggataatactagatattattagtagtaggcatctactattaatgaaaggagagattgctaagagagagctttgcatcctattagctagttggtggggtaaaggcctaccaaggctatgataggtagccggcccgagaggtgaacggccacaaggggactgagatacggcccttactcctacgggaggcagcagtggggaatattggacaatggaggaaactctgatccagcaattctgtgtgcacgaagaaggttttcggattgtaaagtgctttcagtagggaagaagaagatgacggtacctacagaagaagcgacggctaaatacgtgccagcagccgcggtaatacgtatgtcgcaagcgttatccggaattattgggcttaaagggcatctaggcggtctaacaagttgaaggtgaaaagctgtggctcaaccatagtcttgcctacaaaactgtcagactagagtactggaaaggtgggtggaactacacgagtagaggtgaaattcgtagatatgtgtaggaatgccgatgatgaagataactcactggacagaaactgacgctgaagtgcgaaacgtaggggagcaaacaggattagataccctggtagtcctagctgtaaacgatgatcactgggtgtgggggtgtgaagcctctgtgccgaagcaaaagcgataagtgatccgcctggggagtacgtacgcaagtatgaaactcaaaggaattgacggggacccgcacaagtggtggagcatgtggtttaattcgacgcaacgcgaggaaccttaccaggtcttgacatactcggaataagatggaagcatcttagtgcctttgggaaccgagatacaggtggtgcatggctgtcgacagctcgtgtcgtgagatgttgggttaagtcccgcaacgagcgaaacccctatcattagttgccatcattaagttggggactctaatgaaactgcccgcgacgagcaggaggaaggtggggatgacgtcaagtcattctgccccttatgatctgggctacacacgtgctacaatgggtagtacaaagaggagctaagcagtgatgtggagcaaatctttcaaagctactctcagttcggattgaagtctgcaactcgacttcatgaagttggaatcactagtaatcgcaaatcagcaatgttgcggtgaatacgttctcgggtcttgtacacaccgcccgtcacaccacgagagttagttgcacctgaagttactggcctaacccgtaagggagggaagtacctaaggtgtgattagtgattggggtgaagtcgtaacaaggtagccgta

SEQ ID NO: 1785 - DNA, 1550 bp, Streptococcus agalactiae
tgagagtttgatcctggctcaggacgaacgctggcggcgtgcctaatacattgcaagtagaacgctgagggttttggtgtttacactagactgatgagttgcgaacgggtgagtaacgcgtaggtaacctgcctccatagcgggggataactattggaaacgatagctaataccgcataagagtaattaacacatgttagttatttaaaaggagcaattgcttcactgtgagatggacctgcgttgtattagctagttggtgaggtaaaggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgttagagaagaacgttggtaggagtggaaaatctaccaagtgacggtaactaaccagaaagggacggctaactacgtgccagcagccgcggtaatacgtaggtcccgagcgttgtccggatttattgggcgtaaagcgagcgcaggcggttctttaagtctgaagttaaaggcagtggcttaaccattgtacgctttggaaactggaggacttgagtgcagaaggggagagtggaattccatgtgtagcggtgaaatgcgtagatatatgagggaccaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccttctgaccggcctagagataggctttctcttcggagcagaagtgacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttct

SEQ ID NO: 1786 - DNA, 1437 bp, Streptococcus alactolyticus
atggctcaggacgaacgctggcggcgtgcctaatacatgcaagtagaacgctgaagaaaggagcttgcttcttttggatgagttgcgaacgggtgagtaacgcgtaggtaacctgccttgtagcgggggataactattggaaacgatagctaataccgcataacagcttttgacacatgttagaagcttgaaagatgcaattgcatcactacgagatggacctgcgttgtattagctagtaggtagggtaacggcctacctaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaacgtgtgtgagagtggaaagttcacacagtgacggtaacttaccagaaagggacggctaactacgtgccagcagccgcggtaatacgtaggtcccgagcgttgtccggatttattgggcgtaaagcgagcgcaggcggtttaataagtctgaagttaaaggcagtggcttaaccattgttcgctttggaaactgttaaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccagtgaccgctctagagatagagtttttcttcggaacactggtgacaggtggtgcatggttgtcgtcagctcgtgtcgtgagatgttgggttaagtcccgcaacgagcgcaacccttattgttagttgccatcattcagttgggcactctagcgagactgccggtaataaaccggaggaaggtggggatgacgtcaaatcatcatgccccttatgacctgggctacacacgtgctacaatggttggtacaacgagtcgcaagtcggtgacggcaagcaaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaacc

SEQ ID NO: 1787 - DNA, 1553 bp, Streptococcus anginosus
tgagagtttgatcctggctcaggacgaacgctggcggcgtgcctaatacatgcaagtaggacgcacagtttataccgtagcttgctacaccatagactgtgagttgcgaacgggtgagtaacgcgtaggtaacctgcctattagagggggataactattggaaacgatagctaataccgcataacagtatgtaacacatgttagatgcttgaaagatgcaattgcatcgctagtagatggacctgcgttgtattagctagtaggtagggtaatggcctacctaggcgacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgttaaggaagaacgagtgtgaaaatggaaagttcatactgtgacggtacttaaccagaaagggacggctaactacgtgccagcagccgcggtaatacgtaggtcccgagcgttgtccggatttattgggcgtaaagcgagcgcaggcggttagaaaagtctgaagtgaaaggcagtggctcaaccattgtaggctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttaggtcctttccgggacttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctatttctagagataggaagtttcttcggaacatcggtgacaggtggtgcatggttgtcgtcagctcgtgtcgtgagatgttgggttaagtcccgcaacgagcgcaacccttattgttagttgccatcattgagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctctgaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtgaagtcgtaacaaggtagccgtatcggaaggggcggctggatcacctcctttct

SEQ ID NO: 1788 - DNA, 938 bp, Streptococcus australis
  modified_base (26)..(27): a, c, t, g, unknown or other
  modified_base (26)..(27): a, c, t, g, unknown or other
  modified_base (35)..(35): a, c, t, g, unknown or other
  modified_base (35)..(35): a, c, t, g, unknown or other
  modified_base (287)..(287): a, c, t, g, unknown or other
  modified_base (287)..(287): a, c, t, g, unknown or other
  modified_base (929)..(929): a, c, t, g, unknown or other
  modified_base (929)..(929): a, c, t, g, unknown or other
gccagcagccgcggtaatacgtaggnncgagcgtnatccggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtncacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagctttccttcgggacagaggtgacaggtggtgcatggttgtcgtcagctcgtgtcgtgagatgttgggttaagtcccgcaacgagcgcaacccctattgttagttgccatcatttagttgggcactctagcgagactgccggtaataaaccggaggaaggtggggatgacgtcaaatcatcatgccccttatgacctgggctacacacgtgctacaatggctggtacaacgagtcgcgagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtanccttttagg

SEQ ID NO: 1789 - DNA, 1546 bp, Streptococcus bovis
tgagagtttgatcctggctcaggacgaacgctggcggcgtgcctaatacatgcaagtagaacgctgactactttagcttgctagagtagaaggagttgcgaacgggtgagtaacgcgtaggtaacctgcctactagcgggggataactattggaaacgatagctaataccgcataacagtgtttaacacatgttagatgcttgaaagatgcaattgcatcactagtagatggacctgcgttgtattagctagttggtggggtaacggcccaccaaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaacgtgtgtgagagtggaaagttcacacagtgacggtaacttaccagaaagggacggctaactacgtgccagcagccgcggtaatacgtaggtcccgagcgttgtccggatttattgggcgtaaagcgagcgcaggcggtttaataagtctgaagttaaaggcagtggcttaaccattgttcgctttggaaactgttaaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctatttctagagatagaaagtttcttcggaacatcggtgacaggtggtgcatggttgtcgtcagctcgtgtcgtgagatgttgggttaagtcccgcaacgagcgcaacccctattgttagttgccatcatttagttgggcactctagcgagactgccggtaataaaccggaggaaggtggggatgacgtcaaatcatcatgccccttatgacctgggctacacacgtgctacaatggttggtacaacgagtcgcaagtcggtgacggcaagcaaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccatttaggagccagccgcctaaggtgggatagatgattggggtgaagtcgtaacaaggtagccgtatcggaaggtgcggctggatcacctcctttct

SEQ ID NO: 1790 - DNA, 1472 bp, Streptococcus canis
tgtttgatcctggctcaggacgaacgctggcggcgtgcctaatacatgcaagtagaacgctgaggacaggtgcttgcactagtctaaggagttgcgaacgggtgagtaacgcgtaggtaacctacctgatagcgggggataactattggaaacgatagctaataccgcataaaagtgcttaacacatgttaagaacttaaaaggggcaactgctccactatgagatggacctgcgttgtattagctagttggtgaggtaaaggctcaccaaggcgacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgttagagaagaacggtaatgggagtggaaaacccattatgtgacggtaactaaccagaaagggacggctaactacgtgccagcagccgcggtaatacgtaggtcccgagcgttgtccggatttattgggcgtaaagcgagcgcaggcggttctttaagtctgaagttaaaggcattggctcaaccaatgtatgctttggaaactggagaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttagcccctttccggggcttagtgccggagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgcccgctctagagatagagttttacttcggtacatcggtgacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctctgaaagccaatctcagttcggattgtaggctgcaactcgcctacatgaagtcggaatcgctagtaatcgcggatcagcacgccgcggtgaatacgttcccgggcctggtacacaccgcccgtcacaccacgagagtttgtaacacccgaagtcggtgaggtaacctattaggagccagccgcctaaggtgg

SEQ ID NO: 1791 - DNA, 1508 bp, Streptococcus constellatus
gacgaacgctggcggcgtgcctaatacatgcaagtagaacgcacaggatgcaccgtagtttactacaccgtattctgtgagttgcgaacgggtgagtaacgcgtaggtaacctgcctggtagcgggggataactattggaaacgatagctaataccgcataagaacatttactgcatggtagatgtttaaaaggtgcaagagcatcactaccagatggacctgcgttgtattagctagttggtgaggtaacggctcaccaaggcaacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgttaaggaagaacgtgtgtgagagtggaaagttcacacagtgacggtacttaaccagaaagggacggctaactacgtgccagcagccgcggtaatacgtaggtcccgagcgttgtccggatttattgggcgtaaagcgagcgcaggcggttagataagtctgaagtgaaaggcagtggctcaaccattgtaggctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttaggtcctttccgggacttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgcccgctctagagatagagctttacttcggtacatcggtgacaggtggtgcatggttgtcgtcagctcgtgtcgtgagatgttgggttaagtcccgcaacgagcgcaacccttattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctctgaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtgaagtcgtaacaaggtagccgtatcggaagg

SEQ ID NO: 1792 - DNA, 1544 bp, Streptococcus cristatus
tgagagtttgatcctggctcaggacgaacgctggcggcgtgcctaatacatgcaagtagaacgctgaaggaggagcttgctcttctggatgagttgcgaacgggtgagtaacgcgtaggtaacctacctggtagcgggggataactattggaaacgatagctaataccgcataatattgactattgcatgatagtcaattaaaaggtgcaaatgcaccactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccggtgcccgtcctagagataggattttgcttcggcacaccggtgacaggtggtgcatggttgtcgtcagctcgtgtcgtgagatgttgggttaagtcccgcaacgagcgcaacccttattgttagttgccatcatttagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttct

SEQ ID NO: 1793 - DNA, 1555 bp, Streptococcus downei
tgagagtttgatcctggctcaggacgaacgctggcggcgtgcctaatacatgcaagtggaacgcattgatatcaccggagcttgctccactgatattaatgagtcgcgaacgggtgagtaacgcgtaggtaacctgcctgatagcgggggataactattggaaacgatagctaataccgcatgagagtgtttaacacatgttagagacttaaaagataccattgtatcactatcagatggacctgcgttgtattagctagttggtagggtagcggcctaccaaggcaccgatacatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaagctctgttgtagcggaagaacgcgtgtaagagtggaaagtttacacagtgacggtacgctaccagaaagggacggctaactacgtgccagcagccgcggtaatacgtaggtcccgagcgttgtccggatttattgggcgtaaagggagcgcaggcggtttagtaagtctgaagttaaaggcattggctcaaccaatgtatgctttggaaactgttagacttgagtgcagaaggggagagtggaattccatgtgtagcggtgaaatgcgtagatatatggaggaacaccggtggcgaaagcggctctctggtctgtcactgacgctgaggctcgaaagcgtgggtagcgaacaggattagataccctggtagtccacgccgtaaacgatgagtgctaggtgttaggtcctttccgggacttagtgccgcagctaacgcaataagcactccgcctggggagtacgaccgcaaggttgaaactcaaaggaattgacgggggcccgcacaagcggtggagcatgtggtttaattcgaagcaacgcgaagaaccttaccaggtcttgacatcccgatgcccgctctagagatagagttttactttttgtacatcggagacaggtggtgcatggttgtcgtcagctcgtgtcgtgagatgttgggttaagtcccgcaacgagcgcaacccttattgttagttgccatcattgagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctctgaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccaaagtcggtgaggtaaccttataggagccagccgcctaaggtgggacagatgattggggtgaagtcgtaacaaggtagccgtatcggaaggtgcggctggatcacctcctttct

SEQ ID NO: 1794 - DNA, 1546 bp, Streptococcus dysgalactiae
tgagagtttgatcctggctcaggacgaacgctggcggcgtgcctaatacatgcaagtagaacgctgaggactggtgcttgcaccggtccaaggagttgcgaacgggtgagtaacgcgtaggtaacctacctcatagcgggggataactattggaaacgatagctaataccgcataaaagtgtttaacccatgttaaccatttaaaaggtgcaattgcatcactatgagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgttagagaagaatgatggtgggagtggaaaatccaccatgtgacggtaactaaccagaaagggacggctaactacgtgccagcagccgcggtaatacgtaggtcccgagcgttgtccggatttattgggcgtaaagcgagcgcaggcggttctttaagtctgaagttaaaggcagtggctcaaccattgtacgctttggaaactggagaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccggagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctcctgaccggtctagagataggctttcccttcggggcaggagtgacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaacctattaggagccagccgcctaaggtgggatagatgattggggtgaagtcgtaacaaggtagccgtatcggaaggtgcggctggatcacctcctttct

SEQ ID NO: 1795 - DNA, 1545 bp, Streptococcus equi
gagagtttgatcctggctcaggacgaacgctggcggcgtgcctaatacatgcaagtagaacgcagaggtcaggtgcttgcactagactgatgagttgcgaacgggtgagtaacgcgtaggtaacctagcttatagcgggggataactattggaaacgatagctaataccgcataaaagtggttgacccatgttaacgatttaaaaggagcaacagctccactatgagatggacctgcgttgtattagctagttggtagggtaaaggcctaccaaggcgacgatacatagccgacctgagagggtgaacggccacactgggactgagacacggcccagactcctacgggaggcagcagtagggaatcttcggcaatggggggaaccctgaccgagcaacgccgcgtgagtgaagaaggttttcggatcgtaaagctctgttgttagagaagaacagtgatgggagtggaaagtccatcatttgacggtaactaaccagaaagggacggctaactacgtgccagcagccgcggtaatacgtaggtcccgagcgttgtccggatttattgggcgtaaagcgagcgcaggcggtttgataagtctgaagttaaaggcagtggcttaaccattgtatgctttggaaactgttaaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgctgagtgctaggtgttaggccctttccggggcttagtgccgtagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctattcttagagataagaagttacttcggtacattggagacaggtggtgcatggttgtcgtcagctcgtgtcgtgagatgttgggttaagtcccgcaacgagcgcaacccttattgttagttgccatcattaagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctctgaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgttaaggagccagccgcctaaggtgggatagatgattggggtgaagtcgtaacaaggtagccgtatcggaaggtgcggctggatcacctcctttct

SEQ ID NO: 1796 - DNA, 1545 bp, Streptococcus equinus
tgagagtttgatcctggctcaggacgaacgctggcggcgtgcctaatacatgcaagtagaacgctgaagactttagcttgctaaagttggaagagttgcgaacgggtgagtaacgcgtaggtaacctgcctactagcgggggataactattggaaacgatagctaataccgcataacagcatttaacacatgttagatgcttgaaagaagcaattgcttcactagtagatggacctgcgttgtattagctagttggtgaggtaaaggctcaccaaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaacgtgtgtgagagtggaaagttcacacagtgacggtaacttaccagaaagggacggctaactacgtgccagcagccgcggtaatacgtaggtcccgagcgttgtccggatttattgggcgtaaagcgagcgcaggcggtttaataagtctgaagttaaaggcagtggcttaaccattgttcgctttggaaactgttagacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctatttctagagataggaagtttcttcggaacatcggtgacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcgagtcggtgacggcaagcaaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttggagccagccgcctaaggtgggatagatgattggggtgaagtcgtaacaaggtagccgtatcggaaggtgcggctggatcacctcctttct

SEQ ID NO: 1797 - DNA, 1546 bp, Streptococcus gallolyticus
tgagagtttgatcctggctcaggacgaacgctggcggcgtgcctaatacatgcaagtagaacgctgactactttagcttgctagagtagaaggagttgcgaacgggtgagtaacgcgtaggtaacctgcctactagcgggggataactattggaaacgatagctaataccgcataacagtgtttaacacatgttagatgcttgaaagatgcaaatgcatcactagtagatggacctgcgttgtattagctagttggtggggtaacggcctaccaaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaacgtgtgtgagagtggaaagttcacacagtgacggtaacttaccagaaagggacggctaactacgtgccagcagccgcggtaatacgtaggtcccgagcgttgtccggatttattgggcgtaaagcgagcgcaggcggtttaataagtctgaagttaaaggcagtggcttaaccattgttcgctttggaaactgttaaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctatttctagagatagaaagtttcttcggaacatcggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggttggtacaacgagtcgcaagtcggtgacggcaagcaaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttct

SEQ ID NO: 1798 - DNA, 1293 bp, Streptococcus sp.
  C1
gatgaacgctggcggcgtgcctaatacatgcaagtagaacgagttgcgaacgggtgagtaacgcgtaggtaacctgcctcttagcgggggataactattggaaacgatagctaataccgcataagaaagtcactaagagatggacctgcgttgtattagctagttggtgaggtaacggctcaccaaggcgacgatacatagccgacctgggagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagatgacggtaacttaccagaaagggacggctaactacgtgccagcagccgcggtaatacgtaggtcccgagcgttatccggatttattgggcgtaaagcgagcgcaggcggttagataggtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgactgacgctgaggctcgaaagcgtggggagcaaacaggattagataccctggtagtccacgccgtaaacgatgagtgctgggtgttgggtactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccctattgttagttgccatcatgggcactctagcgagactgccggtaataaaccggaggaaggtggggatgacgtcaaatcatcatgccccttatgacctgggctacacacgtgctacaatggctggcaacgagtcgcgagtcggtgacggcaagctaatctcttccagtctcagttcggatgtaggctgcaactcgcctacagaagtcggaatcgctagtaatcgcggatcagcacgccgcggtgaatacgttcccgggccttgtacacaccgcccgtcacaccacgagagtttgtaacacccgaagtcggtaggtagccagccgcctaaggtgggatagatgattggggtg

SEQ ID NO: 1799 - DNA, 1294 bp, Streptococcus sp.
  C2
gacgaacgctggcggcgtgcctaatacatgcaagtagaacgagttgcgaacgggtgagtaacgcgtaggtaacctgcctggtagcgggggataactattggaaacgatagctaataccgcataagaaaagtcactaccagatggacctgcgttgtattagctagttggtgaggtaacggctcaccaaggcgacgatacatagccgacctgagagggtgattggccacactgggactgagacacggcccagactcctacgggaggcagcagtagggaatcttcggcaatggacggaagtctgaccgagcaacgccgcgtgtgtgaagaaggttttcggatcgtaaagctctgttgtaagagaagatgacggtatcttaccagaaagggacggctaactacgtgccagcagccgcggtaatacgtaggtcccaagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgactgacgctgaggctcgaaagcgtggggagcaaacaggattagataccctggtagtccacgccgtaaacgatgagtgctaggtgttagacgtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcgacccctattgttagttgccatcatgggcactctagcgagactgccggtaataaaccggaggaaggtggggatgacgtcaaatcatcatgccccttatgacctgggctacacacgtgctacaatggctggcaacgagtcgcaagccggtgacggcaagctaatctcttccagtctcagttcggatgtaggctgcaactcgcctacagaagtcggaatcgctagtaatcgcggatcagcacgccgcggtgaatacgttccctggccttgtacacaccgcccgtcacaccacgagagtttgtaacacccgaagtcggtaggtagccagccgcctaaggtgggatagatgattggggtg

SEQ ID NO: 1800 - DNA, 1327 bp, Streptococcus sp.
  C3
gacgaacgctggcggcgtgcctaatacatgcaagtagaacgagttgcgaacgggtgagtaacgcgtaggtaacctgcctggtagcgggggataactattggaaacgatagctaataccgcataaagaaagtcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagatgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgactgacgctgaggctcgaaagcgtggggagcaaacaggattagataccctggtagtccacgccgtaaacgatgagtgctaggtgttagacgtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccctattgctagttgccatcatgggcactctagcgagactgccggtaataaaccggaggaaggtggggatgacgtcaaatcatcatgccccttatgacctgggctacacacgtgctacaatggctggcaacgagtcgcaagccggtgacggcaagctaatctcttccagtctcagttcggatgtaggctgcaactcgcctacagaagtcggaatcgctagtaatcgcggatcagcacgccgcggtgaatacgttcccgggccttgtacacaccgcccgtcacaccacgagagtttgtaacacccgaagtcggtaggtagccagccgcctaaggtgggatagatgattggggtgaagtcgtaacaaggtagccgtatcggaaggtgc

SEQ ID NO: 1801 - DNA, 1327 bp, Streptococcus sp.
  C4
gacgaacgctggcggcgtgcctaatacatgcaagtagaacgagttgcgaacgggtgagtaacgcgtaggtaacctgcctggtagcgggggataactattggaaacgatagctaataccgcataaaaaaagtcactaccagatggacctgcgttgtattagctagttggtggggtaacggctcaccaaggcaacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagatgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgactgacgctgaggctcgaaagcgtggggagcaaacaggattagataccctggtagtccacgccgtaaacgatgagtgctaggtgttagacgtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccctattgttagttgccatcatgggcactctagcgagactgccggtaataaaccggaggaaggtggggatgacgtcaaatcatcatgccccttatgacctgggctacacacgtgctacaatggctggcaacgagtcgcaagccggtgacggcaagctaatctcttccagtctcagttcggatgtaggctgcaactcgcctacagaagtcggaatcgctagtaatcgcggatcagcacgccgcggtgaatacgttcccgggccttgtacacaccgcccgtcacaccacgagagtttgtaacacccgaagtcggtaggtagccagccgcctaaggtgggatagatgattggggtgaagtcgtaacaaggtagccgtatcggaaggtgc

SEQ ID NO: 1802 - DNA, 1294 bp, Streptococcus sp.
  C5
gacgaacgctggcggcgtgcctaatacatgcaagtagaacgagttgcgaacgggtgagtaacgcgtaggtaacctgcctggtagcgggggataactattggaaacgatagctaataccgcataacgaaagtcactaccagatggacctgcgttgtattagctagttggtggggtaacggctcaccaaggcgacgatacatagccgacctgagagggtgatcggccacactgggactgagacacggcccagactcctacgggaggcagcagtagggagtcttcggcaatggacggaagtctgaccgagcaacgccgcgtgagtgaagaaggttttcggatcgtaaagctctgttgtaagagaagatgacggtatcttaccagaaagggacggctaactacgtgccagcagccgcggtaatacgtaggtcccgagcgttgtccggatttattgggtgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgactgacgctgaggctcgaaagcgtggggagcaaacaggattagataccctggtagtccacgccgtaaacgatgagtgctaggtgttagacgtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccctattgttagttgccatcatgggcactctagcgagactgccggtaataaaccggaggaaggtggggatgacgtcaaatcatcatgccccttatgacctgggctacacacgtgctacaatggctggcaacgagtcgcaagtcggtgacggcaagctaatctcttccagtctcagttcggatgtaggctgcaactcgcctacagaagtcggaatcgctagtaatcgcggatcagcacgccgcggtgaatacgttcccgggccttgtacacaccgcccgccacaccacgagagtttgtaacacccgaagtcggtaggtagccagccgcctaaggtgggatagatgattggggtg

SEQ ID NO: 1803 - DNA, 1293 bp, Streptococcus sp.
  C6
gatgaacgctggcggcgtgcctaatacatgcaagtagaacgagttgcgaacgggtgagtaacgcgtaggtaacctgcctcttagcgggggataactattggaaacgatagctaataccgcataagaaagtcactaagagatggacctgcgttgtattagctagttggtgaggtaacggctcaccaaggcgacgatacacagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagatgacggtaacttaccagaaagggacggctaactacgtgccagcagccgcggtaatacgtaggtcccgagcgttatccggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgactgacgctgaggctcgaaagcgtggggagcaaacaggattagataccctggtagtccacgccgtaaacgatgagtgctaggtgttgggtactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggccttgacatcgacaggtggtgcatggttgtcgtcagctcgtgtcgtgagatgttgggttaagtcccgcaacgagcgcaacccctattgttagttgccatcatgggcactctagcgagactgccggtaataaaccggaggaaggtggggatgacgtcaaatcatcatgccccttatgacctgggctacacacgtgctacaatggctggcaacgagtcgcgagtcggtgacggcaagctaacctcttccagtctcagttcggatgtaggctgcaactcgcctacagaagtcggaatcgctagtaatcgcagatcagcacgccgcggtgaatacgttcccgggccttgtacacaccgcccgtcacaccacgagagtttgtaacacccgaagtcggtaggttgccagccgcctaaggtgggatagatgattggggtg

SEQ ID NO: 1804 - DNA, 1294 bp, Streptococcus sp.
  C7
gatgaacgctggcggcgtgcctaatacatgcaagtagaacgagttgcgaacgggtgagtaacgcgtaggtaacctgcctcttagcgggggataactattggaaacgatagctaataccgcataaagaaagtcactaagagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaggctctgttgtaagagaagatgacggtatcttaccagaaagggacggctaactacgtgccagcagccgcggtaatacgtaggtcccgagcgttatccggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgactgacgctgaggctcgaaagcgtggggagcaaacaggattagataccctggtagtccacgccgtaaacgatgagtgctaggtgttgggtactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccctattgttagttgccatcatgggcactctagcgagactgccggtaataaaccggaggaaggtggggatgacgtcaaatcatcatgccccttatgacctgggctacacacgtgctacaatggctggcaacgagtcgcgagtcggtgacggcaagctaatctcttccagtctcagttcggatgtaggctgcaactcgcctacagaagtcggaatcgctagtaatcgcggatcagcacgccgcggtgaatacgttcccgggccttgtacacaccgcccgtcacaccacgagagtttgtaacacccgaagtcggtaggtagccagccgcctaaggtgggatagatgattggggtg

SEQ ID NO: 1805 - DNA, 1327 bp, Streptococcus sp.
  C8
gacgaacgctggcggcgtgcctaatacatgcaagtagaacgagttgcgaacgggtgagtaacgcgtaggtaacctgcctggtagcgggggataactattggaaacgatagctaataccgcataataaaagtcactaccagatggacctgcgttgtattagctagttggtgaggtaacggctcaccaaggcaacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagatgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgactgacgctgaggctcgaaagcgtggggagcaaacaggattagataccctggtagtccacgccgtaaacgatgagtgctaggtgttagacgtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccctattgttagttgccatcatgggcactctagcgagactgccggtaataaaccggaggaaggtggggatgacgtcaaatcatcatgccccttatgacctgggctacacacgtgctacaatggctggcaacgagtcgcaagccggtgacggcaagctaatctcttccagtctcagttcggatgtaggctgcaactcgcctacagaagtcggaatcgctagtaatcgcggatcagcacgccgcggtgaatacgttcccgggccttgtacacaccgcccgtcacaccacgagagtttgtaacacccgaagtcggtaggtagccagccgcctaaggtgggatagatgattggggtgaagtcgtaacaaggtagccgtatcggaaggtgc

SEQ ID NO: 1806 - DNA, 962 bp, Streptococcus gordonii
  modified_base (17)..(17): a, c, t, g, unknown or other
  modified_base (17)..(17): a, c, t, g, unknown or other
  modified_base (953)..(953): a, c, t, g, unknown or other
  modified_base (953)..(953): a, c, t, g, unknown or other
agaaagggacggctaantacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgcccgctctagagatagagttttacttcggtacatcggtgacaggtggtgcatggttgtcgtcagctcgtgtcgtgagatgttgggttaagtcccgcaacgagcgcaacccttattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgcaagtcggtgaggtanccttttagg

SEQ ID NO: 1807 - DNA, 1546 bp, Streptococcus infantarius
tgagagtttgatcctggctcaggacgaacgctggcggcgtgcctaatacatgcaagtagaacgctgaaaactttagcttgctaaagtttgaagagttgcgaacgggtgagtaacgcgtaggtaacctgcctactagcgggggataactattggaaacgatagctaataccgcataacagcatttaacccatgttagatgcttgaaaggagcaattgcttcactagtagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaatgtgtgtgagagtggaaagttcacacagtgacggtaacttaccagaaagggacggctaactacgtgccagcagccgcggtaatacgtaggtcccgagcgttgtccggatttattgggcgtaaagcgagcgcaggcggtttaataagtctgaagttaaaggcagtggcttaaccattgttcgctttggaaactgttagacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctattcctagagataggaagtttcttcggaacatcggtgacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcgagtcggtgacggcaagcaaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttct

SEQ ID NO: 1808 - DNA, 1547 bp, Streptococcus infantis
tgagagtttgatcctggctcaggatgaacgctggcggcgtgcctaatacatgcaagtagaacgctgaagcttggtgcttgcaccgagcggatgagttgcgaacgggtgagtaacgcgtaggtaacctgcctggtagcgggggataactattggaaacgatagctaataccgcatgacaacagttattgcatgataactgtttaaaaggggcaattgctccactaccagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttatccggatttattgggcgtaaagcgagcgcaggcggttagataagtctgaagttaaaggctgtggcttaaccatagtacgctttggaaactgtttaacttgagtgcaagaggggaagagtggaattccatgtgtagcggtgtaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgtagctaacgcattaagcactccgcctggggagtacgatcgcaaggttgaaactcaaaggaattgacgggggcccgcacaagcggtggagcatgtggtttaattcgaagcaacgcgaagaaccttaccaggtcttgacatccctctgaccgctctggagatagagttttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccatttggagccagccgcctaaggtgggatagatgattggggtgaagtcgtaacaaggtagccgtatcggaaggtgcggctggatcacctcctttct

SEQ ID NO: 1809 - DNA, 1544 bp, Streptococcus intermedius
tttgatcctggttcaggacgaacgctggcggcgtgcctaatacatgcaagtagaacgcacaggatgcaccgtagtttactacaccgtattctgtgagttgcgaacgggtgagtaacgcgtaggtaacctgcctggtagcgggggataactattggaaacgatagctaataccgcataagaacatttactgcatggtagatgtttaaaaggtgcaaatgcatcactaccagatggacctgcgttgtattagctagtaggtgaggtaacggctcacctaggcgacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgttaaggaagaacgagtgtgagaatggaaagttcatactgtgacggtacttaaccagaaagggacggctaactacgtgccagcagccgcggtaatacgtaggtcccgagcgttgtccggatttattgggcgtaaagcgagcgcaggcggttagataagtctgaagttaaaggcagtggctcaaccattgtaggctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttaggtcctttccgggacttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgcccgctctagagatagagctttacttcggtacatcggtgacaggtggtgcatggttgtcgtcagctcgtgtcgtgagatgttgggttaagtcccgcaacgagcgcaacccttattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctctgaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtgaagtcgtaacaaggtagccgtatcggaaggtgcggctggatcacctcctt

SEQ ID NO: 1810 - DNA, 1395 bp, Streptococcus lutetiensis
  modified_base (1383)..(1383): a, c, t, g, unknown or other
  modified_base (1383)..(1383): a, c, t, g, unknown or other
gaagactttagcttgctaaagttggaagagttgcgaacgggtgagtaacgcgtaggtaacctgcctactagcgggggataactattggaaacgatagctaataccgcataacagcatttaacccatgttagatgcttgaaaggagcaattgcttcactagtagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaacgtgtgtgagagtggaaagttcacacagtgacggtaacttaccagaaagggacggctaactacgtgccagcagccgcggtaatacgtaggtcccgagcgttgtccggatttattgggcgtaaagcgagcgcaggcggtttaataagtctgaagttaaaggcagtggcttaaccattgttcgctttggaaactgttagacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctattcctagagataggaagtttcttcggaactgtgagacttgagggcagaagggtagagtgcacttgtatggggagctgtggaatgcgttcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcgagtcggtgacggcaagcaaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtanccttttaggagc

SEQ ID NO: 1811 - DNA, 1470 bp, Streptococcus massiliensis
gatgaacgctggcggcgtgcctaatacatgcaagtagaacgcagaggattggtgcttgcactaatctaatgagttgcgaacgggtgagtaacgcgtaggtaacctgcctggtagcgggggataactattggaaacgatagctaataccgcataatagtttatgactcatgttataaacttgaaagatacaactgtatcactaccagatggacctgcgttgtattagctagtaggtagggtaacggcctacctaggcgacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgttaaggaagaacgggagtaggagtggaaagcctactttgtgacggtacttaaccagaaagggacggctaactacgtgccagcagccgcggtaatacgtaggtcccgagcgttatccggatttattgggcgtaaagcgagcgcaggcggttagataagtctggagtaaaaggctatggctcaaccatagtgtgctctggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttaggccctttccggggcttagtgccgtagctaacgcaataagcactccgcctggggagtacgaccgcaaggttgaaactcaaaggaattgacgggggcccgcacaagcggtggagcatgtggtttaattcgaagcaacgcgaagaaccttaccaggtcttgacatcccgatgcccgtcctagagataggattttacttcggtacatcggtgacaggtggtgcatggttgtcgtcagctcgtgtcgtgagatgttgggttaagtcccgcaacgagcgcaacccttattgttagttgccatcattgagttgggcactctagcgagactgccggtaataaaccggaggaaggtggggatgacgtcaaatcatcatgccccttatgacctgggctacacacgtgctacaatggctggtacaacgagtcgcaagtcggtgacgacaagctaatctctgaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtg

SEQ ID NO: 1812 - DNA, 945 bp, Streptococcus milleri
  modified_base (934)..(934): a, c, t, g, unknown or other
  modified_base (934)..(934): a, c, t, g, unknown or other
gtctataccgtagcttgctacaccataggctgtgagttgcgaacgggtgagtaacgcgtaggtaacctgcctattagagggggataactattggaaacgatagctaataccgcataacagtatgtaacacatgttagatgcttgaaagatgcaattgcatcgctagtagatggacctgcgttgtattagctagtaggtagggtaatggcctacctaggcaacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgttaaggaagaacgagtgtgagaatggaaagttcatactgtgacggtacttaaccagaaagggacggctaactacgtgccagcagccgcggtaatacgtaggtcccgagcgttgtccggatttattgggcgtaaagcgagcgcaggcggttagaaaagtctgaagtgaaaggcagtggctcaaccattgtaggctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttaggtcctttccgggacttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcntgacatcccag

SEQ ID NO: 1813 - DNA, 976 bp, Streptococcus mitis
  modified_base (47)..(47): a, c, t, g, unknown or other
  modified_base (47)..(47): a, c, t, g, unknown or other
  modified_base (135)..(136): a, c, t, g, unknown or other
  modified_base (135)..(136): a, c, t, g, unknown or other
  modified_base (143)..(143): a, c, t, g, unknown or other
  modified_base (143)..(143): a, c, t, g, unknown or other
  modified_base (154)..(154): a, c, t, g, unknown or other
  modified_base (154)..(154): a, c, t, g, unknown or other
  modified_base (244)..(244): a, c, t, g, unknown or other
  modified_base (244)..(244): a, c, t, g, unknown or other
ggaaagttcacactgtgacggtatcttaccagaaagggacggctaantacgtgccagcagccgcggtaatacgtaggtcccgagcgttgtccggatttattgggcgtaaagcgagcgcaggcggttagataagtnngaagttnaaggctgtggnttaaccatagtacgctttggaaactgtttaacttgagtgcaagaggggagagtggaattccatgtgtagcggtgaaatgcgtagatatanggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcatttagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtg

SEQ ID NO: 1814 - DNA, 971 bp, Streptococcus mutans
  modified_base (950)..(950): a, c, t, g, unknown or other
  modified_base (950)..(950): a, c, t, g, unknown or other
agaacacactgtgcttgcacaccgtgttttcttgagtcgcgaacgggtgagtaacgcgtaggtaacctgcctattagcgggggataactattggaaacgatagctaataccgcataatattaattattgcatgataattgattgaaagatgcaagcgcatcactagtagatggacctgcgttgtattagctagttggtaaggtaagagcttaccaaggcgacgatacatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaagctctgttgtaagtcaagaacgtgtgtgagagtggaaagttcacacagtgacggtagcttaccagaaagggacggctaactacgtgccagcagccgcggtaatacgtaggtcccgagcgttgtccggatttattgggcgtaaagggagcgcaggcggtcaggaaagtctggagtaaaaggctatggctcaaccatagtgtgctctggaaactgtctgacttgagtgcagaaggggagagtggaattccatgtgtagcggtgaaatgcgtagatatatggaggaacaccagtggcgaaagcggctctctggtctgtcactgacgctgaggctcgaaagcgtgggtagcgaacaggattagataccctggtagtccacgccgtaaacgatgagtgctaggtgttaggccctttccggggcttagtgccggagctaacgcaataagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctnttcttagagataggaagttac

SEQ ID NO: 1815 - DNA, 1510 bp, Streptococcus oligofermentans
cggcgtgcctaatacatgcaagtagaacgctgaaggaaggagcttgctctttccggaagagttgcgaacgggtgagtaacgcgtaggtaacctaccttttagcgggggataactattggaaacgatagctaataccgcataagacattttactgcatggtaagatgttaaaagatgcaaatgcatcactaagagatggacctgcgttgtattagctagtaggtgaggtaacggctcacctaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtaacttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttgggtcctttccgggactcagtgccgtagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccggtgcccgtcctagagataggattttgcttcggcacaccggtgacaggtggtgcatggttgtcgtcagctcgtgtcgtgagatgttgggttaagtcccgcaacgagcgcaacccttattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcaccttctta

SEQ ID NO: 1816 - DNA, 801 bp, Streptococcus oralis
  modified_base (507)..(507): a, c, t, g, unknown or other
  modified_base (507)..(507): a, c, t, g, unknown or other
  modified_base (520)..(520): a, c, t, g, unknown or other
  modified_base (520)..(520): a, c, t, g, unknown or other
  modified_base (551)..(551): a, c, t, g, unknown or other
  modified_base (551)..(551): a, c, t, g, unknown or other
  modified_base (591)..(591): a, c, t, g, unknown or other
  modified_base (591)..(591): a, c, t, g, unknown or other
  modified_base (625)..(625): a, c, t, g, unknown or other
  modified_base (625)..(625): a, c, t, g, unknown or other
  modified_base (682)..(682): a, c, t, g, unknown or other
  modified_base (682)..(682): a, c, t, g, unknown or other
  modified_base (696)..(697): a, c, t, g, unknown or other
  modified_base (696)..(697): a, c, t, g, unknown or other
  modified_base (713)..(713): a, c, t, g, unknown or other
  modified_base (713)..(713): a, c, t, g, unknown or other
  modified_base (737)..(737): a, c, t, g, unknown or other
  modified_base (737)..(737): a, c, t, g, unknown or other
  modified_base (751)..(751): a, c, t, g, unknown or other
  modified_base (751)..(751): a, c, t, g, unknown or other
  modified_base (784)..(784): a, c, t, g, unknown or other
  modified_base (784)..(784): a, c, t, g, unknown or other
tgcttctctggatgagttgcgaacgggtgagtaacgcgtaggtaacctgcctggtagcgggggataactattggaaacgatagctaataccgcataagattgattattgcatgatagtcaattaaaaggtgcaattgcatcactaccagatggacctgcgttgtattagctagttggtgaggtaacggctcaccaaggcaacgatacataaccgacctgagagggtgatcggccacactgggactgagacacggcccaaactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccataaagggacggctaactacgtgccagcagccgcggtaatacgtaggtcccgagcgttgtccggatttattgggcgtaaagcgagcgcangcggttagataantctgaagttaaaggctgtggcttaaccatantacgctttggaaactgtttaacttgagtgcaagagggganagtggaattccatgtgtagcggtgaaatgcgtanatatatggaggaacaccggtggcgaaagcggctctctggcttgtaactgacgctgangctcgaaagcgtgnngagcaaacaggattanataccctggtagtccacgccgtanacgatgagtgctangtgttagaccctttccggggtttagtgccgcanctaacgcattaagcact

SEQ ID NO: 1817 - DNA, 1393 bp, Streptococcus parasanguinis
  modified_base (1384)..(1384): a, c, t, g, unknown or other
  modified_base (1384)..(1384): a, c, t, g, unknown or other
gctgaagcttggtgcttgcaccgagcggaagagttgcgaacgggtgagtaacgcgtaggtaacctgcctcttagcgggggataactattggaaacgatagctaataccgcataaaagtcgacattgcatgatgttgacttgaaaggtgcaactgcaccactaagagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtaacttaccagaaagggacggctaactacgtgccagcagccgcggtaatacgtaggtccgagcgttatccggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtcacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttacccggtcttgacatccctctgaccgctctagagatagagctttccttcgggacagaggtgacaggtggtgcatggttgtcgtcagctcgtgtcgtgagatgttgggttaagtcccgcaacgagcgcaacccctattgttagttgccatcatttagttgggcactctagcgagactgccggtaataaaccggaggaaggtggggatgacgtcaaatcatcatgccccttatgacctgggctacacacgtgctacaatggctggtacaacgagtcgcgagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtanccttttagg

SEQ ID NO: 1818 - DNA, 1372 bp, Streptococcus pasteurianus
gaaatggagtttgatcctggctcaggacgaacgctggcggcgtgcctaatacatgcaagtagaacgagttgcgaacgggtgagtaacgcgtaggtaacctgcctactagcgggggataactattggaaacgatagctaataccgcataacgaaagtcactagtagatggacctgcgttgtattagctagttggtggggtaacggcccaccaaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagatgacggtaacttaccagaaagggacggctaactacgtgccagcagccgcggtaatacgtaggtcccgagcgttgtccggatttattgggcgtaaagcgagcgcaggcggtttaataagtctgaagttaaaggcagtggcttaaccattgttcgctttggaaactgttaaacttgagtgcagaaggggagagtggaattccatgtgtagcggtgaaatgcgtagatatatggaggaacaccggtggcgaaagcggctctctggtctgactgacgctgaggctcgaaagcgtggggagcaaacaggattagataccctggtagtccacgccgtaaacgatgagtgctaggtgttaggcgcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccctattgttagttgccatcatgggcactctagcgagactgccggtaataaaccggaggaaggtggggatgacgtcaaatcatcatgccccttatgacctgggctacacacgtgctacaatggttggcaacgagtcgcaagtcggtgacggcaagcaaatctcttccaatctcagttcggatgtaggctgcaactcgcctacagaagtcggaatcgctagtaatcgcggatcagcacgccgcggtgaatacgttcccgggccttgtacacaccgcccgtcacaccacgagagtttgtaacacccgaagtcggtaggtagccagccgcctaaggtgggatagatgattggggtgaagtcgtaacaaggtagccgtatcggaaggtgcggctggatcacctcctttct

SEQ ID NO: 1819 - DNA, 1543 bp, Streptococcus peroris
tgagagtttgatcctggctcaggatgaacgctggcggcgtgcctaatacatgcaagtagaacgctgaaggaggagcttgcttctctggatgagttgcgaacgggtgagtaacgcgtaggtaacctgcctggtagcgggggataactattggaaacgatagctaataccgcataagagcagttgttgcatgacagctgtttaaaaggtgcaattgcaccactaccagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaacgagtgtgagagtggaaagttcacgctgtgacggtatcttaccagaaagggacggctaactacgtgccagcagccgcggtaatacgtaggtcccgagcgttatccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgccatttctagagataggaagttacttcggtacatcggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcgagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccatttggagccagccgcctaaggtgggatagatgattggggtgaagtcgtaacaaggtagccgtatcggaaggtgcggctggatcacctcctttct

SEQ ID NO: 1820 - DNA, 1365 bp, Streptococcus pneumoniae
agcttgcttctccggatgagttgcgaacgggtgagtaacgcgtaggtaacctgcctggtagcgggggataactattggaaacgatagctaataccgcataagagtagatgttgcatgacatttgcttaaaaggtgcaattgcatcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaggctgtggcttaaccatagtacgctttggaaactgtttaacttgagtgcaagaggggagagtggaattccatgtgtagcggtgaaatgcgtagatataggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgcagctaacgcattaagcactccgcctggggagtacgaccgcaaggttgaaactcaaaggaattgacgggggcccgcacaagcggtggagcatgtggtttaattcgaagcgacgcgaagaaccttaccaggtcttgacttccctctgaccgctctagagatagagttttccttcgggacagaggtgacaggtggtgcatggttgtcgtcagctcgtgtcgtgagatgttgggttaagtcccgcaacgagcgcaacccctattgttagttgccatcatttagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtg

SEQ ID NO: 1821 - DNA, 1445 bp, Streptococcus porcinus
cgctggcggcgtgcctaatacatgcaagtagaacgcagaggacaggtgcttgcaccagtctaatgagttgcgaacgggtgagtaacgcgtaggtaacctaccttatagcgggggataactattggaaacgatagctaataccgcatgaaagtagaagacacatgtcatctacttaaaaggggcaaatgctctactatgagatggacctgcgttgtattagctagttggtgaggtaaaggctcaccaaggcgacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgttagagaagaacggtaatgggagtggaaaatccattacgtgacggtaactaaccagaaagggacggctaactacgtgccagcagccgcggtaatacgtaggtcccgagcgttgtccggatttattgggcgtaaagcgagcgcaggcggtttgataagtctgaagttaaaggctgtggcttaaccatagttcgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccggagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccttctgaccgtcctagagataggatttcccttcggggcaggagtgacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccatttaggagccagccgcctaagg

SEQ ID NO: 1822 - DNA, 1376 bp, Streptococcus pseudopneumoniae
tgcaagtagaacgctgaaggaggagcttgcttctctggatgagttgcgaacgggtgagtaacgcgtaggtaacctgcctggtagcgggggataactattggaaacgatagctaataccgcataagagtagatgttgcatgacatttrcttaaaaggtgcaattgcatcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtscggawttattgggcgtaaagcgagcgcaggcggttagataagtctgaagttaaaggctgtggcttaaccatagtaggctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgtagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagctttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaac

SEQ ID NO: 1823 - DNA, 1545 bp, Streptococcus pseudoporcinus
gagagtttgatcctggctcaggacgaacgctggcggcgtgcctaatacatgcaagtagaacgctgaggtctggtgcttgcactagaccaaggagttgcgaacgggtgagtaacgcgtaggtaacctacctcatagcgggggataactattggaaacgatagctaataccgcatgagactggggttcacatgaacccgagttaaaaggagcaaaagcttcactatgagatggacctgcgttgtattagctagttggtgaggtaaaggctcaccaaggcgacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgttagagaagaacggtaatgggagtggaaaatccattatgtgacggtaactaaccagaaagggacggctaactacgtgccagcagccgcggtaatacgtaggtcccgagcgttgtccggatttattgggcgtaaagcgagcgcaggcggtttgataagtctgaagttaaaggctgtggcttaaccatagtatgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccggagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccttctgaccggcctagagataggctttctcttaggagcagaagagacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttct

SEQ ID NO: 1824 - DNA, 1547 bp, Streptococcus pyogenes
gagagtttgatcctggctcaggacgaacgctggcggcgtgcctaatacatgcaagtagaacgctgagaactggtgcttgcaccggttcaaggagttgcgaacgggtgagtaacgcgtaggtaacctacctcatagcgggggataactattggaaacgatagctaataccgcataagagagactaacgcatgttagtaatttaaaaggggcaattgctccactatgagatggacctgcgttgtattagctagttggtgaggtaaaggctcaccaaggcgacgatacatagccgacctgagagggtgatcggccacactgggactgagacacggcccagactcctacgggaggcagcagtagggaatcttcggcaatgggggcaaccctgaccgagcaacgccgcgtgagtgaaagaaggttttcggatcgtaaagctctgttgttagagaagaatgatggtgggagtggaaaatccaccaagtgacggtaactaaccagaaagggacggctaactacgtgccagcagccgcggtaatacgtaggtcccgagcgttgtccggatttattgggcgtaaagcgagcgcaggcggttttttaagtctgaagttaaaggcattggctcaaccaatgtacgctttggaaactggagaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccggagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgcccgctctagagatagagttttacttcggtacatcggtgacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaacctattaggagccagccgcctaaggtgggatagatgattggggtgaagtcgtaacaaggtagccgtatcggaaggtgcggctggatcacctcctttcta

SEQ ID NO: 1825 - DNA, 1334 bp, Streptococcus ratti
  modified_base (66)..(66): a, c, t, g, unknown or other
  modified_base (66)..(66): a, c, t, g, unknown or other
  modified_base (85)..(85): a, c, t, g, unknown or other
  modified_base (85)..(85): a, c, t, g, unknown or other
  modified_base (138)..(138): a, c, t, g, unknown or other
  modified_base (138)..(138): a, c, t, g, unknown or other
  modified_base (142)..(142): a, c, t, g, unknown or other
  modified_base (142)..(142): a, c, t, g, unknown or other
  modified_base (207)..(207): a, c, t, g, unknown or other
  modified_base (207)..(207): a, c, t, g, unknown or other
  modified_base (240)..(240): a, c, t, g, unknown or other
  modified_base (240)..(240): a, c, t, g, unknown or other
  modified_base (260)..(261): a, c, t, g, unknown or other
  modified_base (260)..(261): a, c, t, g, unknown or other
  modified_base (282)..(284): a, c, t, g, unknown or other
  modified_base (282)..(284): a, c, t, g, unknown or other
  modified_base (449)..(449): a, c, t, g, unknown or other
  modified_base (449)..(449): a, c, t, g, unknown or other
  modified_base (475)..(475): a, c, t, g, unknown or other
  modified_base (475)..(475): a, c, t, g, unknown or other
  modified_base (493)..(493): a, c, t, g, unknown or other
  modified_base (493)..(493): a, c, t, g, unknown or other
  modified_base (523)..(523): a, c, t, g, unknown or other
  modified_base (523)..(523): a, c, t, g, unknown or other
  modified_base (842)..(843): a, c, t, g, unknown or other
  modified_base (842)..(843): a, c, t, g, unknown or other
  modified_base (855)..(855): a, c, t, g, unknown or other
  modified_base (855)..(855): a, c, t, g, unknown or other
  modified_base (926)..(926): a, c, t, g, unknown or other
  modified_base (926)..(926): a, c, t, g, unknown or other
  modified_base (954)..(954): a, c, t, g, unknown or other
  modified_base (954)..(954): a, c, t, g, unknown or other
  modified_base (956)..(956): a, c, t, g, unknown or other
  modified_base (956)..(956): a, c, t, g, unknown or other
  modified_base (1018)..(1018): a, c, t, g, unknown or other
  modified_base (1018)..(1018): a, c, t, g, unknown or other
  modified_base (1070)..(1070): a, c, t, g, unknown or other
  modified_base (1070)..(1070): a, c, t, g, unknown or other
  modified_base (1121)..(1121): a, c, t, g, unknown or other
  modified_base (1121)..(1121): a, c, t, g, unknown or other
  modified_base (1295)..(1295): a, c, t, g, unknown or other
  modified_base (1295)..(1295): a, c, t, g, unknown or other
  modified_base (1304)..(1304): a, c, t, g, unknown or other
  modified_base (1304)..(1304): a, c, t, g, unknown or other
gaacgggtgagtaacgcgtaggtaacctgcctattagcgggggataactattggaaacgatagctnataccgcataagagagttnaacacatgttagacgcttgaaagatgcaagagcatcactagtagatggacctncgtngtattagctagtaggtagggtaaaggcctacctaggcgacgatacatagccgacctgagagggtnaccggccacactgggactgagacacggcccagnctcctacgggaggcagcagnngggaatcttcggcaatggggnnnaccctgaccgagcaacgccgcgtgagtgaagaaggttttcggatcgtaaagctctgttgtcagagacgaacgtgtgtgagagtggaaagttcacacagtgacggtaactgaccagaaagggacggctaactacgtgccagcagccgcggtaatacgtaggtcccnagcgttgtccggatttattgggcgtnaagcgagcgcaggcggtnttgtaagtctgaagtcaaaggcagtggctnaaccattgtgtgctttggaaactgcaggacttgagtgcagaaggggagagtggaattccatgtgtagcggtgaaatgcgtagatatatggaggaacaccggtggcgaaagcggctctctggtctgtaactgacgctgaggctcgaaagcgtgggtagcgaacaggattagataccctggtagtccacgccgtaaacgctgagtgctaggtgttaggccctttccggggcttagtgccggagctaacgcattaagcactccgcctggggagtacgaccgcaaggttgaaactcaaaggaattgacgggggccgcacaagnngtggagcatgtngtttaattcgaagcaacgcgaagaaccttaccaggtcttgacatcccgatgcccgctctagagatagagtnttactttcgtacatcggtgacaggtggngnatggttgtcgtcagctcgtgtcgtgagatgttgggttaagtcccgcaacgagcgcaaccctnattgttagttgccatcattgagttgggcactctagcgagactgccggtaatnaaccggaggaaggtggggatgacgtcaaatcatcatgccccttatgacctnggctacacacgtgctacaatggtcggtacaacgagtcgcgagccggtgacggcaagctaatctctgaaagccgatctcagttcggattggaggctgcaactcgcctccatgaagtcggaatcgctagtaatcgcggatcagcacgccgcggtgaatacgttcccgggccttgtncacaccgcncgtcacaccacgagagtttgtaacacccga

SEQ ID NO: 1826 - DNA, 1012 bp, Streptococcus salvarius
  modified_base (998)..(998): a, c, t, g, unknown or other
  modified_base (998)..(998): a, c, t, g, unknown or other
  modified_base (1005)..(1006): a, c, t, g, unknown or other
  modified_base (1005)..(1006): a, c, t, g, unknown or other
tagaacgctgaagagaggagcttgctcttcttggatgagttgcgaacgggtgagtaacgcgtaggtaacctgccttgtagcgggggataactattggaaacgatagctaataccgcataacaatggatgacacatgtcatttatttgaaaggggcaattgctccactacaagatggacctgcgttgtattagctagtaggtgaggtaacggctcacctaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagtcaagaacgagtgtgagagtggaaagttcacactgtgacggtagcttaccagaaagggacggctaactacgtgccagcagccgcggtaatacgtaggtcccgagcgttgtccggatttattgggcgtaaagcgagcgcaggcggtttgataagtctgaagttaaaggctgtggctcaaccatagttcgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttggatcctttccgggattcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctatttctagagatagaaagttacttcggtacatcggtgacaggtggngcatggnngtcgtc

SEQ ID NO: 1827 - DNA, 966 bp, Streptococcus sanguinis
  modified_base (47)..(48): a, c, t, g, unknown or other
  modified_base (47)..(48): a, c, t, g, unknown or other
  modified_base (700)..(700): a, c, t, g, unknown or other
  modified_base (700)..(700): a, c, t, g, unknown or other
  modified_base (714)..(714): a, c, t, g, unknown or other
  modified_base (714)..(714): a, c, t, g, unknown or other
  modified_base (721)..(721): a, c, t, g, unknown or other
  modified_base (721)..(721): a, c, t, g, unknown or other
  modified_base (799)..(799): a, c, t, g, unknown or other
  modified_base (799)..(799): a, c, t, g, unknown or other
  modified_base (855)..(855): a, c, t, g, unknown or other
  modified_base (855)..(855): a, c, t, g, unknown or other
  modified_base (917)..(917): a, c, t, g, unknown or other
  modified_base (917)..(917): a, c, t, g, unknown or other
  modified_base (920)..(920): a, c, t, g, unknown or other
  modified_base (920)..(920): a, c, t, g, unknown or other
  modified_base (930)..(930): a, c, t, g, unknown or other
  modified_base (930)..(930): a, c, t, g, unknown or other
  modified_base (955)..(955): a, c, t, g, unknown or other
  modified_base (955)..(955): a, c, t, g, unknown or other
cgctgaagagaggagcttgctcttcttggatgagttgcgaacgggtnngtaacgcgtaggtaacctgcctggtagcgggggataactattggaaacgatagctaataccgcatgaaattgcttatcgcatgataattaattgaaagatgcaactgcatcactaccagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgtaagagaagaacgggtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtatgctttggaaactgtttaacttgagtgcagaaggggagagtggaattccatgtgtagcggtgaaatgcgtagatatatggaggaacaccggtggcgaaagcggctctctggtctgtaactgacgctgangctcgaaagcgtgnggagcanacaggattagataccctggtagtccacgccgtaaacgatgagtgctaggtgttaggccctttccggggcttagtgccncagctaacgcattaagcactccgcctggggagtacgaccgcgaggttgaaactcanaggaattgacgggggcccgcacaagcggtggagcatgtggtttaattcgaagcaacgcgaanaancttaccaggncttgacatccctctgaccgctctanagatagagttt

SEQ ID NO: 1828 - DNA, 1510 bp, Streptococcus sinensis
agtttgatcctggctcaggacgaacgctggcggcgtgcctaatacatgcaagtggaacgcacaaggtgcaccgtagtttactacaccgtactttgtgagtcgcgaacgggtgagtaacgcgtaggtaacctaccttttagcgggggataactattggaaacgatagctaataccgcataagatatcttactgcatggtaagatattaaaagatgcaattgcatcactaagagatggacctgcgttgtattagctagtaggtgaggtaacggctcacctaggcaacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgtaagagaagaacgagtgtgagagtggaaagttcacactgtgacggtaacttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccggtgcccgtcctagagataggattttgcttcggcacaccggtgacaggtggtgcatggttgtcgtcagctcgtgtcgtgagatgttgggttaagtcccgcaacgagcgcaacccttattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaag

SEQ ID NO: 1829 - DNA, 1478 bp, Streptococcus sp.
  16362
gacgaacgctggcggcgtgcctaatacatgcaagtaggacgcacagtctataccgtagcttgctacaccataggctgtgagttgcgaacgggtgagtaacgcgtaggtaacctgcctattagagggggataactattggaaacgatagctaataccgcataatagtatgtaacacatgttagatgcttgaaagatgcaattgcatcgctagtagatggacctgcgttgtattagctagtaggtagggtaaaggcctacctaggcaacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgttaaggaagaatgagtgtgagaatggaaagttcatactgtgacggtacttaaccagaaagggacggctaactacgtgccagcagccgcggtaatacgtaggtcccgagcgttgtccggatttattgggcgtaaagcgagcgcaggcggttagaaaagtctgaagtgaaaggcagtggctcaaccattgtaggctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttaggtcctttccgggacttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctatttctagagataggaagtttcttcggaacatcggtgacaggtggtgcatggttgtcgtcagctcgtgtcgtgagatgttgggttaagtcccgcaacgagcgcaacccttattgttagttgccatcattgagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctctgaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtg

SEQ ID NO: 1830 - DNA, 1501 bp, Streptococcus sp.
  2285-97
gacgaacgctggcggcgtgcctaatacatgcaagtagaacgctgaggtcatgtgcttgcacaagaccaaggagttgcgaacgggtgagtaacgcgtaggtaacctgcctcatagcgggggataactattggaaacgatagctaataccgcatgagagtttttaacacatgttaggaacttaaaaggagcaactgcttcactatgagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgttagagaagaatggaagtaggagtggaaagtctacttcgtgacggtaactaaccagaaagggacggctaactacgtgccagcagccgcggtaatacgtaggtcccgagcgttgtccggatttattgggcgtaaagcgagcgcaggcggttctataagtctgaagttaaaggcagtggctcaaccattgttcgctttggaaactgtagaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgcccgctctagagatagagttttacttcggtacatcggagacaggtggtgcatggttgtcgtcagctcgtgtcgtgagatgttgggttaagtcccgcaacgagcgcaacccctattgttagttgccatcattcagttgggcactctagcaagactgccggtaataaaccggaggaaggtggggatgacgtcaaatcatcatgccccttatgacctgggctacacacgtgctacaatggttggtacaacgagtcgcaagtcggtgacgacaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaagg

SEQ ID NO: 1831 - DNA, 1401 bp, Streptococcus sp.
  2_1_36FAA
  modified_base (1392)..(1392): a, c, t, g, unknown or other
  modified_base (1392)..(1392): a, c, t, g, unknown or other
acagtttatatcgtagcttgctacaccatagactgtgagttgcgaacgggtgagtaacgcgtaggtaacctgcctggtagcgggggataactattggaaacgatagctaataccgcataatattaattattgcatgataattaattgaaaggtgcaattgcaccactaccagatggacctgcgttgtattagctagtaggtgaggtaacggctcacctaggcgacgatacatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaagctctgttgtaagagaagaacgggtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtgggagcgaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacctcccgatgcccgctctagagatagagttttacttcggtacatcggtgacaggtggtgcatggttgtcgtcagctcgtgtcgtgagatgttgggttaagtcccgcaacgagcgcaacccttattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgcaagtcggtgaggtanccttttagg

SEQ ID NO: 1832 - DNA, 1395 bp, Streptococcus sp.
  69130
  modified_base (39)..(40): a, c, t, g, unknown or other
  modified_base (39)..(40): a, c, t, g, unknown or other
  modified_base (44)..(44): a, c, t, g, unknown or other
  modified_base (44)..(44): a, c, t, g, unknown or other
  modified_base (89)..(89): a, c, t, g, unknown or other
  modified_base (89)..(89): a, c, t, g, unknown or other
  modified_base (831)..(831): a, c, t, g, unknown or other
  modified_base (831)..(831): a, c, t, g, unknown or other
agttgcgaacgggtgagtaacgcgtaggtaacctacctnntagngggggataactattggaaacgatagctaataccgcataacagtangtaacacatgttagatgcttgaaagatgcaattgcatcgctagtagatggacctgcgttgtattagctagtaggtagggtaatggcctacctaggcgacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgttaaggaagaacgagtgtgagaatggaaagttcatgctgtgacggtacttaaccagaaagggacggctaactacgtgccagcagccgcggtaatacgtaggtcccgagcgttgtccggatttattgggcgtaaagcgagcgcaggcggttagaaaagtctgaagtgaaaggcagtggctcaaccattgtaggctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttaggtcctttccgggacttagtgccgcagctaacgcattaagcactccgcctggggagtacgaccgcaaggttgaaactcaaaggaattnacgggggccgcacaagcggtggagcatgtggtttaattcgaagcaacgcgaagaaccttaccaggtcttgacatcccagtgactgccctagagatagggttttccttcggggcactggtgacaggtggtgcatggttgtcgtcagctcgtgtcgtgagatgttgggttaagtcccgcaacgagcgcaacccttattgttagttgccatcattgagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctctgaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaagagccagccgcctaaggtgggatagatgattgggg

SEQ ID NO: 1833 - DNA, 1272 bp, Streptococcus sp.
  AC15
gacgaacgctggcggcgtgcctaatacatgcaagtaggacgagttgcgaacgggtgagtaacgcgtaggtaacctgcctattagagggggataactattggaaacgatagctaataccgcataacgaaagtcgctagtagatggacctgcgttgtattagctagtaggtagggtaatggcctacctaggcgacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgttaaggaagatgacggtacttaaccagaaagggacggctaactacgtgccagcagccgcggtaatacgtaggtcccgagcgttgtccggatttattgggcgtaaagcgagcgcaggcggttagaaaagtctgaagtgaaaggcagtggctcaaccattgtaggctttggaaactgtttaacttgagtgcagaaggggagagtggaattccatgtgtagcggtgaaatgcgtagatatatggaggaacaccggtggcgaaagcggctctctggtctgactgacgctgaggctcgaaagcgtggggagcgaacaggattagataccctggtagtccacgccgtaaacgatgagtgctaggtgttaggtacttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccttattgttagttgccatcatgggcactctagcgagactgccggtaataaaccggaggaaggtggggatgacgtcaaatcatcatgccccttatgacctgggctacacacgtgctacaatggctggcaacgagtcgcaagccggtgacggcaagctaatctctgccagtctcagttcggatgtaggctgcaactcgcctacagaagtcggaatcgctagtaatcgcggatcagcacgccgcggtgaatacgttcccgggccttgtacacaccgcccgtcacaccacgagagtttgtaacacccgaagtcggtaggtagccagccgcctaa

SEQ ID NO: 1834 - DNA, 1262 bp, Streptococcus sp.
  ACS2
ggcggcgtgcctaatacatgcaagtagaacgagttgcgaacgggtgagtaacgcgtaggtaacctgccttgtagcgggggataactattggaaacgatagctaataccgcataacgaaagccactacaagatggacctgcgttgtattagctagtaggtgaggtaacggctcacctaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagtcaagatgacggtagcttaccagaaagggacggctaactacgtgccagcagccgcggtaatacgtaggtcccgagcgttgtccggatttattgggcgtaaagcgagcgcaggcggtttgataagtctgaagttaaaggctgtggctcaaccatagttcgctttggaaactgtcaaacttgagtgcagaaggggagagtggaattccatgtgtagcggtgaaatgcgtagatatatggaggaacaccggtggcgaaagcggctctctggtctgactgacgctgaggctcgaaagcgtggggagcgaacaggattagataccctggtagtccacgccgtaaacgatgagtgctaggtgttggatattcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccctattgttagttgccatcatgggcactctagcgagactgccggtaataaaccggaggaaggtggggatgacgtcaaatcatcatgccccttatgacctgggctacacacgtgctacaatggttggcaacgagttgcgagtcggtgacggcaagctaatctcttccaatctcagttcggatgtaggctgcaactcgcctacagaagtcggaatcgctagtaatcgcggatcagcacgccgcggtgaatacgttcccgggccttgtacacaccgcccgtcacaccacgagagtttgtaacacccgaagtcggtaggtagccagccgcctaa

SEQ ID NO: 1835 - DNA, 1449 bp, Streptococcus sp.
  AS20
  modified_base (1361)..(1361): a, c, t, g, unknown or other
  modified_base (1361)..(1361): a, c, t, g, unknown or other
acgctggcggcgtgcctaatacatgcaagtagaacgcacaggatgcaccgtagtttactacaccgtattctgtgagttgcgaacgggtgagtaacgcgtaggtaacctgcctggtagcgggggataactattggaaacgatagctaataccgcataagaacatttactgcatggtagatgtttaaaaggtgcaagagcatcactaccagatggacctgcgttgtattagctagttggtgaggtaacggctcaccaaggcaacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgttaaggaagaacgtgtgtgagagtggaaagttcacacagtgacggtacttaaccagaaagggacggctaactacgtgccagcagccgcggtaatacgtaggtcccgagcgttgtccggatttattgggcgtaaagcgagcgcaggcggttagataagtctgaagtgaaaggcagtggctcaaccattgtaggctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttaggtcctttccgggacttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgcccgctctagagatagagctttacttcggtacatcggtgacaggtggtgcatggttgtcgtcagctcgtgtcgtgagatgttgggttaagtcccgcaacgagcgcaacccttattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctctgaaagccagtctcagttcggattgtaggctgcaactcgcctacatgaagtcggaatcgctagtaatcgcggatcagcacgccgcgggtggaatncgttcccgggccttgtacacaccgcccgtcacaccacgagagtttgtaacacccgaagtcggtgaggtaaccgtaaggagccagccgc

SEQ ID NO: 1836 - DNA, 1360 bp, Streptococcus sp.
  BS35a
atacatgcaagtagaacgctgaagagaggagcttgctcttcttggatgagttgcgaacgggtgagtaacgcgtaggtaacctgcctggtagcgggggataactattggaaacgatagctaataccgcataaaatggattatcgcatgataattcattgaaaggtgcaaatgcatcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgcagctaacgcattaagcactccgcctggggagtacgaccgcaaggttgaaactcaaaggaattgacgggggcccgcaccagcggtggagcatgtggtttaatttgaagcaacgcgaagaaccttaccaggtcttgacatccctttgaccgctctagagaaagagttttccttcgggacagaggtgacaggtggtgcatggttgttgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaattttttaaagccagtctcagttcggattgtaggctgcaacttgcctacatgaagttggaatcgctagtaatcgcggatcagcacgccgcggtgaatacgttcccgggccttgtacacaccgccc

SEQ ID NO: 1837 - DNA, 1037 bp, Streptococcus sp.
  C150
  modified_base (995)..(995): a, c, t, g, unknown or other
  modified_base (995)..(995): a, c, t, g, unknown or other
  modified_base (1002)..(1003): a, c, t, g, unknown or other
  modified_base (1002)..(1003): a, c, t, g, unknown or other
  modified_base (1016)..(1016): a, c, t, g, unknown or other
  modified_base (1016)..(1016): a, c, t, g, unknown or other
  modified_base (1018)..(1018): a, c, t, g, unknown or other
  modified_base (1018)..(1018): a, c, t, g, unknown or other
  modified_base (1020)..(1021): a, c, t, g, unknown or other
  modified_base (1020)..(1021): a, c, t, g, unknown or other
  modified_base (1028)..(1028): a, c, t, g, unknown or other
  modified_base (1028)..(1028): a, c, t, g, unknown or other
  modified_base (1030)..(1030): a, c, t, g, unknown or other
  modified_base (1030)..(1030): a, c, t, g, unknown or other
aacgctgaagagaggagcttgctcttcttggatgagttgcgaacgggtgagtaacgcgtaggtaacctgccttgtagcgggggataactattggaaacgatagctaataccgcataacaatggatgacccatgtcatttatttgaaaggggcaaatgctccactacaagatggacctgcgttgtattagctagtaggtgaggtaacggctcacctaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagtcaagaacgagtgtgagagtggaaagttcacactgtgacggtagcttaccagaaagggacggctaactacgtgccagcagccgcggtaatacgtaggtcccgagcgttgtccggatttattgggcgtaaagcgagcgcaggcggtttgataagtctgaagttaaaggctgtggctcaaccatagttcgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttggatcctttccgggattcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctatttctagagatagaaagttacttcggtacatcggtgacaggtggngcatggnngtcgtcagctcgngncnngagatgntngggttaa

SEQ ID NO: 1838 - DNA, 974 bp, Streptococcus sp.
  CM6
tagaacgctgaagagaggagcttgctcttcttggatgagttgcgaacgggtgagtaacgcgtaggtaacctgcctggtagcgggggataactattggaaacgatagctaataccgcataaaattgattatcgcatgataatcaattgaaaggtgcaaatgcatcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttcc

SEQ ID NO: 1839 - DNA, 1432 bp, Streptococcus sp.
  CM7
caggacgaacgctggcggcgtgcctaatacatgcaagtaggacgcacagtttataccgtagcttgctacaccatagactgtgagttgcgaacgggtgagtaacgcgtaggtaacctgcctattagagggggataactattggaaacgatagctaataccgcataacagtatgtaacacatgttagatgcttgaaagatgcaattgcatcgctagtagatggacctgcgttgtattagctagtaggtagggtaatggcctacctaggcgacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgttaaggaagaacgagtgtgaaaatggaaagttcatactgtgacggtacttaaccagaaagggacggctaactacgtgccagcagccgcggtaatacgtaggtcccgagcgttgtccggatttattgggcgtaaagcgagcgcaggcggttagaaaagtctgaagtgaaaggcagtggctcaaccattgtaggctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttaggtcctttccgggacttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctatttctagagataggaagtttcttcggaacatcggtgacaggtggtgcatggttgtcgtcagctcgtgtcgtgagatgttgggttaagtcccgcaacgagcgcaacccttattgttagttgccatcattgagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctctgaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtga

SEQ ID NO: 1840 - DNA, 1387 bp, Streptococcus sp.
  ICM10
  modified_base (1346)..(1352): a, c, t, g, unknown or other
  modified_base (1346)..(1352): a, c, t, g, unknown or other
tagaacgctgaaggaggagcttgctcttctggatgagttgcgaacgggtgagtaacgcgtaggtaacctgcctggtagcgggggataactattggaaacgatagctaataccgcataagagtagatgttgcatgacatttgcttaaaaggtgcaattgcatcactaccagatggacctgcgttgtattagctagttggtgaggtaacggctcaccaaggcaacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgagctcgaaagcgtggggagcaaacaggattagataccctggtagtccacgccgtaaacgatgagtgctaggtgttagaccctttccggggtttagtgccgcagctaacgcattaagcactccgcctggggagtacgaccgcaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcatttagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccnnnnnnncacgagagtttgtaacacccgaagtcggtgaggta

SEQ ID NO: 1841 - DNA, 1439 bp, Streptococcus sp.
  ICM12
ggcggcgtgcctaatacatgcaagtagaacgctgaagagaggagcttgctcttcttggatgagttgcgaacgggtgagtaacgcgtaggtaacctgcctggtagcgggggataactattggaaacgatagctaataccgcataaaatggattatcgcatgataatccattgaaaggtgcaaatgcatcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgatcgctctagagatagagttttccttcgggacagaggtgacaggtggtgcatggttgtcgtcagctcgtgtcgtgagatgttgggttaagtcccgcaacgagcgcaacccctattgttagttgccatcatttagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaa

SEQ ID NO: 1842 - DNA, 1432 bp, Streptococcus sp.
  ICM2
  modified_base (203)..(203): a, c, t, g, unknown or other
  modified_base (203)..(203): a, c, t, g, unknown or other
ggcggcgtgcctaatacatgcaagtagaacgctgaagcttggtgcttgcaccgagcggatgagttgcgaacgggtgagtaacgcgtaggtaacctgcctggtagcgggggataactattggaaacgatagctaataccgcataaaatggattatcgcatgataattcattgaaaggtgcaaatgcatcactaccagatggacntgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcatttagttgggcactctagcgagactgccggtaataaaccggaggaaggtggggatgacgtcaaatcatcatgccccttatgacctgggctacacacgtgctacaatggctggtacaacgagtcgcaagccggtgacggtaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagc

SEQ ID NO: 1843 - DNA, 1261 bp, Streptococcus sp.
  ICM45
cgaacgctggcggcgtgcctaatacatgcaagtagaacgagttgcgaacgggtgagtaacgcgtaggtaacctgcctggtagcgggggataactattggaaacgatagctaataccgcataacaaaagtcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagatgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgactgacgctgaggctcgaaagcgtggggagcaaacaggattagataccctggtagtccacgccgtaaacgatgagtgctaggtgttagacgtttagtgccgtagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccctattgttagttgccatcatgggcactctagcgagactgccggtaataaaccggaggaaggtggggatgacgtcaaatcatcatgccccttatgacctgggctacacacgtgctacaatggctggcaacgagtcgcaagccggtgacggcaagctaatctcttccagtctcagttcggatgtaggctgcaactcgcctacagaagtcggaatcgctagtaatcgcggatcagcacgccgcggtgaatacgttcccgggccttgtacacaccgcccgtcacaccacgagagtttgtaacacccgaagtcggtaggtagcca

SEQ ID NO: 1844 - DNA, 1421 bp, Streptococcus sp.
  ICM4
taatacatgcaagtagaacgctgaagagaggagcttgctcttcttggatgagttgcgaacgggtgagtaacgcgtaggtaacctgccttgtagcgggggataactattggaaacgatagctaataccgcataacaatggatgacacatgtcatttatttgaaaggggcaattgctccactacaagatggacctgcgttgtattagctagtaggtgaggtaacggctcacctaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagtcaagaacgagtgtgagagtggaaagttcacactgtgacggtagcttaccagaaagggacggctaactacgtgccagcagccgcggtaatacgtaggtcccgagcgttgtccggatttattgggcgtaaagcgagcgcaggcggtttgataagtctgaagttaaaggctgtggctcaaccatagttcgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttggatcctttccgggattcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctatttctagagatagaaagttacttcggtacatcggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggttggtacaacgagttgcgagtcggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttggagccagcc

SEQ ID NO: 1845 - DNA, 923 bp, Streptococcus sp.
  M143
  modified_base (882)..(888): a, c, t, g, unknown or other
  modified_base (882)..(888): a, c, t, g, unknown or other
gccgcggtaatacgtaggtcccgagcgttgtccgggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcatttagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccnnnnnnncacgagagtttgtaacacccgaagtcggtgaggta

SEQ ID NO: 1846 - DNA, 1543 bp, Streptococcus sp.
  M334
tgagagtttgatcctggctcaggacgaacgctggcggcgtgcctaatacatgcaagtagaacgctgaaggaggagcttgcttctctggatgagttgcgaacgggtgagtaacgcgtaggtaacctgcctggtagcgggggataactattggaaacgatagctaataccgcataagagtagatgttgcatgacatttgcttaaaaggtgcaattgcatcactaccagatggacctgcgttgtattagctagttggtggggtaacggcttaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgtagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggtaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtgaagtcgtaacaaggtagccgtatcggaaggtgcggctggatcacctcctttct

SEQ ID NO: 1847 - DNA, 1258 bp, Streptococcus sp.
  OBRC6
acgaacgctggcggcgtgcctaatacatgcaagtaggacgagttgcgaacgggtgagtaacgcgtaggtaacctgcctattagagggggataactattggaaacgatagctaataccgcataacgaaagtcgctagtagatggacctgcgttgtattagctagtaggtagggtaatggcctacctaggcgacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgttaaggaagatgacggtacttaaccagaaagggacggctaactacgtgccagcagccgcggtaatacgtaggtcccgagcgttgtccggatttattgggcgtaaagcgagcgcaggcggttagaaaagtctgaagtgaaaggcagtggctcaaccattgtaggctttggaaactgtttaacttgagtgcagaaggggagagtggaattccatgtgtagcggtgaaatgcgtagatatatggaggaacaccggtggcgaaagcggctctctggtctgactgacgctgaggctcgaaagcgtggggagcgaacaggattagataccctggtagtccacgccgtaaacgatgagtgctaggtgttaggtacttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccttattgttagttgccatcatgggcactctagcgagactgccggtaataaaccggaggaaggtggggatgacgtcaaatcatcatgccccttatgacctgggctacacacgtgctacaatggctggcaacgagtcgcaagccggtgacggcaagctaatctctgccagtctcagttcggatgtaggctgcaactcgcctacagaagtcggaatcgctagtaatcgcggatcagcacgccgcggtgaatacgttcccgggccttgtacacaccgcccgtcacaccacgagagtttgtaacacccgaagtcggtaggta

SEQ ID NO: 1848 - DNA, 1447 bp, Streptococcus sp.
  SHV515
  modified_base (84)..(84): a, c, t, g, unknown or other
  modified_base (84)..(84): a, c, t, g, unknown or other
  modified_base (126)..(126): a, c, t, g, unknown or other
  modified_base (126)..(126): a, c, t, g, unknown or other
  modified_base (311)..(311): a, c, t, g, unknown or other
  modified_base (311)..(311): a, c, t, g, unknown or other
  modified_base (1444)..(1444): a, c, t, g, unknown or other
  modified_base (1444)..(1444): a, c, t, g, unknown or other
ttaatcatgagtcgcgaacgggtgagtaacgcgtaggtaacctgcctgatagcgggggataactattggaaacgatagctaatnccgcataagagtcgttaacacatgttaatgatttaaaaggancaattgcttcactatcagatggacctgcgttgtattagctagttggtgaggtaacggctcaccaaggcttcgatacatagccgacctgagagggtgatcggccacactgggactgagacacggcccagactcctacgggaggcagcagtagggaatcttcggcaatggacgaaagtctgaccgancaacgccgcgtgagtgaagaaggttttcggatcgtaaagctctgttataagcgaagaacgggagtaagagtggaaagtttactctgtgacggtagcttatcagaaagggacggctaactacgtgccagcagccgcggtaatacgtaggtcccgagcgttgtccggatttattgggcgtaaagcgagcgcaggtggtttaataagtctgaagttaaaggcattggctcaaccaatgtacgctttggaaactgttgaacttgagtgcagaaggggagagtggaattccatgtgtagcggtgaaatgcgtagatatatggaggaacaccggtggcgaaagcggctctctggtctgtaactgacactgaggctcgaaagcgtgggtagcgaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccagtgaccatcctagagataggatttcccttcggggcactggtgacaggtggtgcatggttgtcgtcagctcgtgtcgtgagatgttgggttaagtcccgcaacgagcgcaacccctattgttagttgccatcattgagttgggcactctagcgagactgccggtaataaaccggaggaaggtggggatgacgtcaaatcatcatgccccttatgacctgggctacacacgtgctacaatggtcggtacaacgagttgcgagctggtgacagtaagctaatctcttaaagccgatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccatttggagccagccgcctaaggtgggatagatgattggggtgaagtcgtaacaaggtagccgtatcggaaggtgcggntgg

SEQ ID NO: 1849 - DNA, 1365 bp, Streptococcus sp.
  oral clone ASB02
  modified_base (336)..(336): a, c, t, g, unknown or other
  modified_base (336)..(336): a, c, t, g, unknown or other
  modified_base (373)..(373): a, c, t, g, unknown or other
  modified_base (373)..(373): a, c, t, g, unknown or other
  modified_base (697)..(697): a, c, t, g, unknown or other
  modified_base (697)..(697): a, c, t, g, unknown or other
  modified_base (1014)..(1014): a, c, t, g, unknown or other
  modified_base (1014)..(1014): a, c, t, g, unknown or other
ggagtttgattatggctcaggatgaacgctggcggcgtgcctaatacatgcaagtagaacgagttgcgaacgggtgagtaacgcgtaggtaacctgcctggtagcgggggataactattggaaacgatagctaataccgcataacgaaagccactaccagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatggacggaagtctgaccgagcaacgccgngtgagtgaagaaggttttcggatcgtaaagctctgtngtaagagaagatgacggtatcttaccagaaagggacggctaactacgtgccagcagccgcggtaatacgtaggtcccgagcgttatccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatgtatggaggaacaccggtggcgaaagcggctctctggcttgactgacgctgaggctcgaaagcgtggggagcatacaggattagatancctggtagtccacgccgtaaacgatgagtgctaggtgttgggtactcagtgccgcagctaacgcattaagcactccgcctggggagtacgaccgcaaggttgaaactcaaaggaattgacaggggcccgcacaagcggtggagcatgtggtttaattcgaagcaacgcgatgaaccttaccaggtcttgacatcgacaggtggtgcatggttgtcgtcagctcgtgtcgtgagatgttgggttaagtcccgcaacgagcgcaacccctattgttagttgccatcatgggcactctagcgagactgccggtaataaancggaggaaggtggggatgacgtcaaatcatcatgccccttatgacctgggctacacacgtgctacaatggctggcaacgagtcgcaagttggtgacggcaagctaatctcttccagtctcagttcggatgtagtctgcaactcgcctccagaagttggattcgctagtaatcgcggatcagccatggcgcggtgaatacgttcccgggccttgtacacaccgcccgtcacaccacgagagtttgtaacacccgaagtcggtaggtagccggccgcctaaggtgggatagatgattggggtgaagtcgtaacaaggtagccgtatcggaaggtgcggctggaacacctcctt

SEQ ID NO: 1850 - DNA, 1363 bp, Streptococcus sp.
  oral clone ASCA03
  modified_base (1014)..(1014): a, c, t, g, unknown or other
  modified_base (1014)..(1014): a, c, t, g, unknown or other
  modified_base (1059)..(1059): a, c, t, g, unknown or other
  modified_base (1059)..(1059): a, c, t, g, unknown or other
  modified_base (1084)..(1084): a, c, t, g, unknown or other
  modified_base (1084)..(1084): a, c, t, g, unknown or other
  modified_base (1123)..(1123): a, c, t, g, unknown or other
  modified_base (1123)..(1123): a, c, t, g, unknown or other
  modified_base (1136)..(1136): a, c, t, g, unknown or other
  modified_base (1136)..(1136): a, c, t, g, unknown or other
  modified_base (1148)..(1148): a, c, t, g, unknown or other
  modified_base (1148)..(1148): a, c, t, g, unknown or other
  modified_base (1160)..(1160): a, c, t, g, unknown or other
  modified_base (1160)..(1160): a, c, t, g, unknown or other
  modified_base (1285)..(1286): a, c, t, g, unknown or other
  modified_base (1285)..(1286): a, c, t, g, unknown or other
  modified_base (1348)..(1348): a, c, t, g, unknown or other
  modified_base (1348)..(1348): a, c, t, g, unknown or other
ggagtttgattctggctcaggacgaacgctggcggcgtgcctaatacatgcaagtagaacgagttgcgaacgggtgagtaacgcgtaggtaacctgcctggtagcgggggataactattggaaacgatagctaataccgcataataaaagtcactaccagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagaaaaaatgacggtatcttaccagaaagggacggctaactactcgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgactgacgctgaggctcgaaagcgtggggagcaaacaggattagataccctggtagtccacgccgtaaacgatgagtgctaggtgttagacgtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccctattgttagttgccatcatgggcactctagcgagactgccggtaataaancggaggaaggtggggatgacgtcaaatcatcatgccccttatgancgggctacacacgtggtacgatggntggcaacgagtcgcaagccggtgacggcaagctaatctnttccagtctcagntcggatgtaggntgcaaatcgccnacagaagtcggaatcgctagtaatcgcggatcagcacgccgcggtgaatacgttcccgggccttgtacacaccgcccgtcacaccacgagagtttgtaacacccgaagtcggtaggtagccagcnncctaaggtgggatagatgattggggtgaagtcgtaacaaggtagccgtatcggaaggtacgnctgggacacctcctt

SEQ ID NO: 1851 - DNA, 1366 bp, Streptococcus sp.
  oral clone ASCA04
  modified_base (1016)..(1016): a, c, t, g, unknown or other
  modified_base (1016)..(1016): a, c, t, g, unknown or other
ggagtttgattatggctcaggactaacgctggcggcgtgcctaatacatgcaagtagaacgagttgcgaacgggtgagtaacgcgtaggtaacctgcctggtagcgggggataactattggaaacgatagctaataccgcataatgaaagtcactaccagatggacctgcgttgtattagctagttggtggggtaagggctcaccaaggcgacgatatatagccgacctgagagggtgatcggccacactgggactgagacacggcccagactcctacgggaggcagcagtagggaatcttcggcaatggacggaagtctgaccgagccacgccgcgtgagtgaagaaggttttcggatcgtaaagctctgttgtaagagaagatgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtaccggtgaaatgggtagatatatggaggaacaccggtggcgaaagcggctctctggcttgactgacgctgaggctcgaaagcgtggggagcaaacaggattagataccctggtagtccacgccgtaaacgatgagtgctaggtgttagacgtttagtgccgtagctaacgcattaagcactccgcctggggagtacgaccgcaaggttgaaactcaaaggaattgacgggggcccgcacaagcggtggagcatgtggtttaattcgaagcaacgcgaaggaccttaccaggtcttgccatcgacaggtgatgcatggttgtcgtcagctcgtgtcgtgagatgttgggttaagtcccgcaacgagcgcaacccctattgttagttgccatcagttgggcactctagcgagactgccggtaataaancggaggaaggtggggatgacgtcaaatcatcatgccccttatgacctgggctacacacgtgctacaatggctggcaacgagtcgcaagccggtgacggcaagctaatctcttccagtctcagttcggatgtaggctgcaactcgcctacagaagtcggaatcgctagtaatcgcggatcagcacgccgcggtgaatacgttcccgggccttgtacacaccgcccgtcacaccacgagagtttgtaacacccgaagtcggtaggtagccagccgcctaaggtgggatagatgattggggtgaagtcgtaacaaggtagccgtatcggaaggtgcggctggaacacctcctt

SEQ ID NO: 1852 - DNA, 1364 bp, Streptococcus sp.
  oral clone ASCA09
  modified_base (1014)..(1014): a, c, t, g, unknown or other
  modified_base (1014)..(1014): a, c, t, g, unknown or other
ggagtttgatcatggctcaggacgaacgctggcggcgtgcctaatacatgcaagtagaacgagttgcgaacgggtgagtaacgcgtaggtaacctgcctggtagcgggggataactattggaaacgatagctaataccgcataacaaaagtcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccacgtgagtgaagaaggttttcggatcgtaaagctctgttgtaagagaagatgacggtatcttaccagaaagggacggctaactacgtgccagcagccgcggtaatacgtaggtcccgagcgttgtccggatttattgggcgtaaagcgagcgcaggcggttagataagtctgaagtaaaaggctgtggcttaaccatagtacgctttggaaactgtttaacttgagtgcaagaggggagagtggaattccatgtgtagcggtgaaatgcgtagatatatggaggaacacccgtggcgaaagcggctctctggcttgactgacgctgaggctcgaaagcgtggggagcaaacaggattagataccctggtagtccacgccgtaaacgatgagtgctaggtgttagacgtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccctattgttagttgccatcatgggcactctagcgagactgccggtaataaancggaggaaggtggggatgacgtcaaatcatcatgccccttatgacctgggctacacacgtgctacaatggctggcaacgagtcgcaagccggtgacggcaagctaatctcttccagtctcagttcggatgtaggctgcaactcgcctacagaagtcggaatcgctagtaatcgcggatcagcacgccgcggtgaatacgttcccgggccttgtacacaccgcccgtcacaccacgagagtttgtaacacccgaagtcggtaggtagccagccgcctaaggtgggatagatgattggggtgaagtcgtaacaaggtagccgtatcggaaggtgcggctggatcacctcctt

SEQ ID NO: 1853 - DNA, 1361 bp, Streptococcus sp.
  oral clone ASCB04
ggagtttgatcatggctcaggacgaacgctggcggcgtgcctaatacatgcaagtagaacgagttgcgaacgggtgagtaacgcgtaggtaacctgcctggtagcgggggataactattggaaacgatagctaataccgcataatgaaagtcactaccagatgaacctgcgttgtattagctagttggtgaggtaacggctcaccaaggcgacgatacatagccgaactgagagggtgaacccccacactgggactgagacacggaccagactcctacgggaggcagcagtagggaatcttcggcaatggacggaagtctgaccgagcaacgccgcgtgagtgaagaaggttttcggatcgtaaagctctgttgtaagagaagatgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgactgacgctgaggctcgaaagcgtggggagcaaacaggattagatacccggtagtccaccccgtaaacgatgagtgctaggtgttagacgtttagtaccgtagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaaccctattgttagttgccatcatgggcactctagcgagactgccggtaataaaccggaggaaggtgggatgacgtcaaatcatcatgccccttatgacctgggctacacacgtgctacaatggctggcaacgagtcgcaagccggtgacggcaagctaatctcttccagtctcagttcggatgtaggctgcaactcgcctacagaagtcggaatcgctagtaatcgcggatcagcacgccgcggtgaatacgttcccgggccttgtacacaccgcccgtcacaccacgagagtttgtaacacccgaagtcggtaggtagccagccgcctaaggtgggatagatgattggggtgaagtcgtaacaaggtagccgtatcggaaggtgcggctggaacacctcctt

SEQ ID NO: 1854 - DNA, 1358 bp, Streptococcus sp.
  oral clone ASCB06
  modified_base (59)..(59): a, c, t, g, unknown or other
  modified_base (59)..(59): a, c, t, g, unknown or other
  modified_base (457)..(457): a, c, t, g, unknown or other
  modified_base (457)..(457): a, c, t, g, unknown or other
ggagtttgattatggctcagatgaacgctggcggcgtgcctaatacatgcaagtagaantagttgcgaacgggtgagtaacgcgtaggtaacctgcctcttagcgggggataactattggaaacgatagctaataccgcataagaaagtcactaagagatggacctgcgttgtattagctagttggtgaggtaacggctcaccaaggcgacgataaatagccgacctgagaggatgatccgccacactgggactgagacacggcccagactcctacgggaggcagcagtagggaatcttcgacaatggacgcaactgacccagcaacgccgcgtgactgaagaaggccttcggatcgtaaagcactgttgtaagagaagatgacggtaacttaccagaaagggacggctaactacgtgccagcagccgcggtaatacgtaggtcccgagcgttatcnggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgactgacgctgaggctcgaaagcgtggggagcaaacaggattagataccctggtagtccaccccgtaaacgatgagtgctaggtgttgggtactcagtgccgcagctaacgcattaagcactccgcctggggagtaccaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaaccctattgttagttgccatcatgggcactctagcgagactgccggtaataaaccggaggaaggtgggatgacgtcaaatcatcatgccccttatgacctgggctacacacgtgctacaatggctggcaacgagtcgcgagtcggtgacggcaagctaatctcttccagtctcagttcggatgtaggctgcaactcgcctacagaagtcggaatcgttagtaatcgcggatcagcacgccgcggtgaatacgttcccgggccttgtacacaccgcccgtcacaccacgagagtttgtaacacccgaagtcggtaggtagtcagccgcctaaggtgggatagatgattggggtgaagtcgtaacaaggtagccgtatcggaaggtgcggctggatcacctcctt

SEQ ID NO: 1855 - DNA, 1359 bp, Streptococcus sp.
  oral clone ASCC04
  modified_base (1012)..(1012): a, c, t, g, unknown or other
  modified_base (1012)..(1012): a, c, t, g, unknown or other
agtttgattatggctcaggatgaacgctggcggcgtgcctaatacatgcaagtagaacgagttgcgaacgggtgagtaacgcgtaggtaacctgcctggtagcgggggataactattggaaacgatagctaataccgcataacgaaagtcactaccagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaggacggtatcttaccagaaagggacggctaactacgtgccagcagctgcggtaatacgtaggtcccgagcgttatccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacatcggtggcgaaagcggctctctggcttgactgacgctgaggctcgaaagcgtggggagcaaacaggattagataccctggtagtccacgccgtaaacgatgagtgctaggtgttgggtactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccctatagttagttgccatcatgggcactctagcgagactgccggtaataaancggaggaaggtggggatgacgtcaaatcatcatgccccttatgacctgggctacacacgtgctacaatggctggcaacgagtcgcaagtcggtgacggcaagctaatctcttccagtctcagttcggatgtaggctgcaactcgcccacagaagtcggaatcgctagtaatcgcggatcagcacgccgcggtgaatacgttcccgggccttgtacacaccgcccgtcacaccacgagagtttgtaacacccgaagtcggtaggtagccagccgcctaaggtgggatagatgattggggtgaagtcgtaacaaggtagccgtatcggaaggtgcggctggaacacctc

SEQ ID NO: 1856 - DNA, 1364 bp, Streptococcus sp.
  oral clone ASCC05
  modified_base (594)..(595): a, c, t, g, unknown or other
  modified_base (594)..(595): a, c, t, g, unknown or other
ggagtttgatcatggctcaggacgaacgctggcggcgtgcctaatacatgcaagtagaacgagttgcgaacgggtgagtaacgcgtaggtaacctgcctggtagcgggggataactattggaaacgatagctaataccgcataacaaaagccactaccagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagatgacggtatcttaccagaaagggacggctaactacgtgccagcagccgcggtaatacgtaggtcccgagcgttatccggatttattgggcgtaaagcgagcgcaggcggttagataagtctgaagttaaaggctgtggcttaaccatagtacgctttggaaactgtttaacttgagtgcaagaggggagagtggaattccatgtgtaccnncgaaatgcgtagatatatggaggaacaccggtggcgaaagcggctctctggcttgactgacgctgaggctcgaaagcgtggggagcaaacaggattagataccccggtagtccacgccgtaaatgatgagtgctaggtgttgggtactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttagcaggtcttgacatcgacaggtggtgcatggttgtcgtcagctcgtgtcgtgagatattgggttaagtcccgcaacgagcgcaacccctattgttagttgccatcatgggcactctagcgagactgccggtaataaaccggaggaaggtggggatgacgtcaaatcatcatgccccttatgacctgggctacacacgtgctacaatggctggcaacgagtcgcaagccggtgacggcaagctaatctcttccagtctcagttcggatgtaggctgcaactcgcctacagaagtcggaatcgctagtaatcgcggatcagcacgccgcggtgaatacgttcccgggccttgtacacaccgcccgtcacaccacgagagtttgtaacacccgaagtcggtaggtagccagccgcctaaggtgggatagatgattggggtgaagtcgtaacaaggtagccgtatcggaaggtgcggctggatcacctcctt

SEQ ID NO: 1857 - DNA, 1564 bp, Streptococcus sp.
  oral clone ASCC12
  modified_base (445)..(445): a, c, t, g, unknown or other
  modified_base (445)..(445): a, c, t, g, unknown or other
  modified_base (936)..(936): a, c, t, g, unknown or other
  modified_base (936)..(936): a, c, t, g, unknown or other
  modified_base (939)..(939): a, c, t, g, unknown or other
  modified_base (939)..(939): a, c, t, g, unknown or other
gacgttttgattcttggctcagtgaccaacgctggcggcgtgcctaatacatgcaagtagaacgctgaaggaggagcttgcttctccggatgacgttgcgaacgggtgagtaacgcgtaggtaacctgcctggtagcgggggataactattggaaacgatagctaataccgcataacagtagatatcgcatgatagctgcttgaaaggtgcaattgcaccactaccagatggacctgcgttgtattagctagttggtgaggtaacggctcaccaaggcaacgatacatagccgacctgagagggtgatcggccacactgggactgagacacggcccagactcctacgggaggcagcagtagggaatcttcggcattgtgacggaagtcttgaccgagccaacgcctcggtgagtgaagaaggttttccggatcgtaaagctctgnttgtaagagacagaacgagttgtgagacgtggaaagttcacactggtgacggtatcttaccagaaagggacggctaactacgtgccagcagccgcggtaatacgtaggtcccaagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaaagcggctctctgggcttgtaactgacgctgaggctcgaaagcgtggggagcaaacaggattagataccctggtagtccacgccgtaaactgatgagtgctaggtgttagaccctttccggggtttagtgccgtagctaacgcattaagcactccgcctggggagtacgaccgcaaggttgaaactcaaaggaatngancgggggcccgcacaagcggtggagcatgtggtttaattcgatgcaacgcgaagaaccttacctggtcttgacatccctgtgaccgttctagagatggattgtttccttcgggagcagaggtgacaggtggtgcatggttgtcgtcagctcgtgtcgtgagatgttgggttaagtcccgcaacgagcgcaacccctattgcttaggtaaaactccccggggagttgggcactctagcgagactgccggtgataaaccggaggaaggtggggatgacgtcaagtcatcatggcccttatgacctgggctacacacgtgctacaatggcgtatacagagggaagcgatagtgcgagctggagcgaatctcacaaagtacgtctaagtccggattggagtctgcaactcgactccatgaagtcggaatcgctagtaatcgcaaatcagaatgttgcggtgaatacgttcccgggccttgtacacaccgcccgtcacaccatgggagtgggttgtaccagaagtagatagcttaaccttttggagggcgtttaccacggtatgattcatgactggggtgaagtcgtaacaaggtaaccgtaggggaacctgcggctggaacacctccttc

SEQ ID NO: 1858 - DNA, 1366 bp, Streptococcus sp.
  oral clone ASCD01
ggagtttgattctggctcaggacgaacgctggcggcgtgcctaatacatgcaagtagaacgagttgcgaacgggtgagtaacgcgtaggtaacctgcctggtagcgggggataactattggaaacgatagctaataccgcataacaaaagtcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagatgatggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgactgacgctgaggctcgaaagcgtggggagcaaacaggattagataccctggtagtccacgccgtaaacgatgagtgctaggtgttagacgtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccctattgttagttgccatcagttgggcgctctagcgagactgccggtaataaaccggaggaaggtggggatgacgtcaaatcatcatgccccttatgacctgggctacacacgtgctacaatggctggcaacgtgtcgcaagccggtgacggcaagctaatctcttccagtctcagttcggatgtaggctgcaactcgcctacagaagtcggaatcgctagtaatcgcggatcagcacgccgcggtgaatacgttcccgggccttgtacacaccgcccgtcacaccacgagagtttgtaacacccgaagtcggtaggtagccagccgcctaaggtgggatagatgattggggtgaagtcgtaacaaggtagccgtatcggaaggtgcggctggaacacctcctt

SEQ ID NO: 1859 - DNA, 1364 bp, Streptococcus sp.
  oral clone ASCD09
  modified_base (1076)..(1076): a, c, t, g, unknown or other
  modified_base (1076)..(1076): a, c, t, g, unknown or other
  modified_base (1078)..(1078): a, c, t, g, unknown or other
  modified_base (1078)..(1078): a, c, t, g, unknown or other
  modified_base (1298)..(1298): a, c, t, g, unknown or other
  modified_base (1298)..(1298): a, c, t, g, unknown or other
  modified_base (1318)..(1318): a, c, t, g, unknown or other
  modified_base (1318)..(1318): a, c, t, g, unknown or other
  modified_base (1357)..(1357): a, c, t, g, unknown or other
  modified_base (1357)..(1357): a, c, t, g, unknown or other
ggagtttgattatggctcaggacgaacgctggcggcgtgcctaatacatgcaagtagaacgagttgcgaacgggtgagtaacgcgtaggtaacctgcctggtagcgggggataactattggaaacgatagctaataccgcataacaaaagtcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttctcggatcgtaaagctctgttgtaagagaagatgacggtatcttaccagacagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgactgacgctgaggctcgaaagcgtggggagcaaacaggatcagataccctggtagtccacgccgtaaacgatgagtgctaggtgttagacgtttagtgccgtagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccctattgttagttgccatcatgggcactctagcgagactgccggtaataaaccggaggaaggtggggatgacgtcaaatcatcatgccccttatgacctgggctacacacgtgntncaatggctggcaacgagtcgcaagccggtgacggcaagctaatctcttccagtctcagttcggatgtaggctgcaactcgcctacagaagtcggaatcgctagtaatcgcggatcagcacgccgcggtgaatacgttcccgggccttgtacacaccgcccgtcacaccacgagagtttgtaacacccgaagtcggtaggtagccagccgcctaaggtggnatagatgattggggggaaancgtaacaaggtagccgtatcggaaggtgcggctggatcncttcctt

SEQ ID NO: 1860 - DNA, 1342 bp, Streptococcus sp.
  oral clone ASCD10
  modified_base (244)..(244): a, c, t, g, unknown or other
  modified_base (244)..(244): a, c, t, g, unknown or other
  modified_base (250)..(250): a, c, t, g, unknown or other
  modified_base (250)..(250): a, c, t, g, unknown or other
gacgaacgctggcggcgtgcctaatacatgtaagtagaacgagttgcgaacgggtgagtaacgcgtaggtaacctgcctggtagcgggggataactattggaaacgatagctaataccgcataacaaaagtcactaccagatggacctgcgttgtattagctagttggtggggtaacggctcaccaaggcgacgatacatagccgacctgagagggtgatcggccacactgggactgagacacngcccanactcctacgggaggcagcagtagggaatcttcggcagtggacggaagtctgaccgagcacgccgcgtgagtgaagaaggtttccggatcgtaaagctctgttgtaagagaagatgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgactgacgctgaggctcgaaagcgtggggagcaaacaggattagataccctggtagtccacgccgtaaacgatgagtgctaggtgttagacgtttagtgccgcagctaacgcattaagcactccgcctggggagtacgaccgcaaggttgaaatcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccctattgttagttgccatcatgggcactctagcgagactgccggtaataaaccggaggaaggtggggatgacgtcaaatcatcatgccccttatgacctgggctacacacgtgctacaatggctggcaacgagtcgcaagccggtgacggcaagctaatctctgccagtctcagttcggatgtaggctgcaactcgcctacagaagtcggaatcgctagtaatcgcggatcagcacgccgcggtgaatacgttcccgggccttgtacacaccgcccgtcacaccacgagagtttgtaacacccgaagtcggtaggtagccagccgcctaaggtgggatagatgattggggtgaagtcgtaacaaggtagccgtatcggaaggtgcggctggaacacctcctt

SEQ ID NO: 1861 - DNA, 1356 bp, Streptococcus sp.
  oral clone ASCE03
  modified_base (1143)..(1143): a, c, t, g, unknown or other
  modified_base (1143)..(1143): a, c, t, g, unknown or other
  modified_base (1343)..(1343): a, c, t, g, unknown or other
  modified_base (1343)..(1343): a, c, t, g, unknown or other
ggagtttgatcctggctcaggacgaacgctggcggcgtgcctaatacatgcaagtagaacgagttacgaacgggtgagtaacgcgtaggtaacctgcctggtagcgggggataactattggaaacgatagctaataccgcataaaaaagtcactaccagatggacctgcgttgtattagctagttggtggggtaaaggcttaccaaggcgacgatacatagccgacctgagagggtgaacggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagatgccggtatcttaccagaaagggacggctaactacgtgccagcagccgcggtaatacgtaggtcccgagcgttgtccggatttattgggcgtaaagggagcgcaggcggttagaaaagtctgaagttaaaggctgtggcttaaccatagtaggctttggaaactgtttaacttgagtgcaagaggggagagtggaattccatgtgtagcggtgaaatgcgtagatatatggaggaacaccggtggcgaaagcggctctctggcttgactgacgctgaggctcgaaagcgtggggatcaaacaggattagataccctggtagtccacgccgtaaacgctgagggctaggtgttagacgtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatctacaggtggtgcatggttgtcgtcagctcgtgtcgtgagatgttgggttaagtcccgcaacgagcgcaacccctattgttagttgccatcatgggcactctagcgagactgccggtaataaaccggaggaaggtggggatgacgtcaaatcatcatgccccttatgacctgggctacacacgtgctacaatggctggcaacgagtcgcaagccggtgacggcaagctaatctctgccagtctcagttcggatntaggctgcaactcgcctacagaagtcggaatcgctagtaatcgcggatcagcacgccgcggtgaatacgttcccgggccttgtacacaccgcccgtcacaccacgagagtttgtaacacccgaagtcggtaggtagccagccgcctaaggtgggatagatgattggggtgaagtcgtaacaaggtagccgtatcgaaagntgcggctggaaca

SEQ ID NO: 1862 - DNA, 1360 bp, Streptococcus sp.
  oral clone ASCE04
  modified_base (31)..(31): a, c, t, g, unknown or other
  modified_base (31)..(31): a, c, t, g, unknown or other
  modified_base (334)..(334): a, c, t, g, unknown or other
  modified_base (334)..(334): a, c, t, g, unknown or other
  modified_base (680)..(680): a, c, t, g, unknown or other
  modified_base (680)..(680): a, c, t, g, unknown or other
  modified_base (684)..(684): a, c, t, g, unknown or other
  modified_base (684)..(684): a, c, t, g, unknown or other
ggagtttgattttggctcaggacgaacgctncggcgtgcctaatacatgcaagtagaacgagttgcgaactggtgagtaacgcgtaggtaacctgcctggtagcgggggataactattggaaacgatagctaataccgcataacaaaagtcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccngtgagtgaagaaggttttcggatcgtaaagctctgttgtaagagaagatgacggtatcttaccagaaagggacggctaactacgtgccagcagccgcggtaatacgtaggtcccgagcgttgtccggatttattgggcgtaaagcgagcgcaggcggttagataagtctgaagtttaaggctgtggcttaaccatagtacgctttggaaactgtttaacttgagtgcaagaggggagagtggaattccatgtgtagcggtgaaatgcgtagatatatggaggaacaccggtggcgaaagcggctctccgcttgactgacgctgaggctcgaaagcgtggggagcanacangattagataccctggtagtcacgccgtaaacgatgagtgctaggtgttagacgtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccctattgttagttgccatcatgggcactctagcgagactgccggtaataaaccggaggaaggtggggatgacgtcaaatcatcatgccccttatgacctgggctacacacgtgctacaatggctggcaacgagtcgcaagccggtgacggcaagctaatctcttccagtctcagttcggatgtaggctgcaactcgcctacagaagtcggaatcgctagtaatcgcggatcagcacgccgcggtgaatacgttcccgggccttgtacacaccgcccgtcacaccacgagagtttgtaacacccgaagtcggtaggtagccagccgcctaaggtgggatagatgattggggtgaagtcgtaacaaggtagccgtatcggaaggtgcggctggatcacctcctt

SEQ ID NO: 1863 - DNA, 1363 bp, Streptococcus sp.
  oral clone ASCE05
  modified_base (544)..(544): a, c, t, g, unknown or other
  modified_base (544)..(544): a, c, t, g, unknown or other
  modified_base (634)..(634): a, c, t, g, unknown or other
  modified_base (634)..(634): a, c, t, g, unknown or other
  modified_base (697)..(697): a, c, t, g, unknown or other
  modified_base (697)..(697): a, c, t, g, unknown or other
  modified_base (727)..(727): a, c, t, g, unknown or other
  modified_base (727)..(727): a, c, t, g, unknown or other
ggagtttgattatggctcaggatgaacgctggcggcgtgcctaatacatgcaagtagaacgagttgcgaacgggtgagtaacgcgtaggtaacctgcctcttagcgggggataactattggaaacgatagctaataccgcataagaaagacactaagagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagatgacggtaacttaccagaaagggacggctaactacgtgccagcagccgcggtaatacgtaggtcccgagcgttatccggatttattgggcgtaaagcgagcgcaggcggttagataagtctgaagttaaaggctgtggcttaaccatagtacgctttgganactgtttaacttgagtgcagaaggggagagtggaattccatgtgtagcggtgaaatgcgtagatatatggaggaacaccggtggcgaaancggctctctggtctgactgacgctgaggctcgaaagcgtggggagcaaacaggattagatagnctggtagtccacgccgtaaacgatgagtgntaggtgttgggtactcagtgccgcagctaacgcattaagcactccgcctgaggagtacgacagcaaggttgaaactcaaaggaattgacgggggcccgcacaagcggtggagcatgtggtttaattcgaagcaacgcgaagaaccttaccaggtcttgacatctacaggtggtgcatggttgtcgtcagctcgtgtcgtgagatgttgggttaagtcccgcaacgagcgcaacccctattgttagttgccatcatgggcactctagcgagactgccggtaataaaccggaggaaggtggggatgacgtcaaatcatcatgccccttatgacctgggctacacacgtgctacaatggctggcaacgagtcgcgagtcggtgacggcaagctaatctcttccagtctcagttcggatgtaggctgcaactcgcctacagaagtcggaatcgctagtaatcgcggatcagcacgccgcggtgaatacgttcccgggccttgtacacaccgcccgtcacaccacgagagtttgtaacacccgaagtcggtaggtagccagcagcctaaggtgggatagatgattggggtgaagtcgtaacaaggtagccgtatcggaaggtgcggctggatcacctcctt

SEQ ID NO: 1864 - DNA, 1364 bp, Streptococcus sp.
  oral clone ASCE06
  modified_base (398)..(398): a, c, t, g, unknown or other
  modified_base (398)..(398): a, c, t, g, unknown or other
  modified_base (401)..(401): a, c, t, g, unknown or other
  modified_base (401)..(401): a, c, t, g, unknown or other
  modified_base (1014)..(1014): a, c, t, g, unknown or other
  modified_base (1014)..(1014): a, c, t, g, unknown or other
ggagtttgattatggctcaggacgaacgctggcggcgtgcctaatacatgcaagtagaacgagttgcgaacgggtgagtaacgcgtaggtaacctgcctggtagcgggggataactattggaaacgatagctaataccgcataacaaaagtcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagacgatgacggtatcttancanaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgactgacgctgaggctcgaaagcgtggggagcaaacaggattagatacccagcaagtccacgccgtaaacgatgagtgctaggtgttagacgtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccctattgttagttgccatcatgggcactctagcgagactgccggtaataaancggaggaaggtggggatgacgtcaaatcatcatgccccttatgacctgggctacacacgtgctacaatggctggcaacgagtcgcaagccggtgacggcaagctaatctcttccagtctcagttcggatgtaggctgcaactcgcctacagaagtcggaatcgctagtaatcgcggatcagcacgccgcggtgaatacgttcccgggccttgtacacaccgcccgtcacaccacgagagtttgtaacacccgaagtcggtaggtagccagccgcctaaggtgggatagatgattggggtgaagtcgtaacaaggtagccgtatcggaaggtgcggttggaacacctcctt

SEQ ID NO: 1865 - DNA, 1365 bp, Streptococcus sp.
  oral clone ASCE09
ggagtttgattatggctcaggacgaacgctggcggcgtgcctaatacatgcaagtagaacgagttgcgaacgggtgagtaacgcgtaggtaacctgcctggtagcgggggataactattggaaacgatagctaataccgcataacaaaagtcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagatgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtaccgctttggaaactgtttaacttgagtgcaagaggggagagtggaattccatgtgtagcggtgaaatgcgtagatatatggaggaacaccggtggcgaaagcggctctctggcttgactgacgctgaggctcgaaagcgtggggagcaaacaggattagataccctggtagtccacgccgtaaacgatgagtgctaggtgttagacgtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccctattgttagttgccatcatgggcactctagcgagactgccggtaataaaccggaggaaggtggggatgacgtcaaatcatcatgccccttatgacctgggctacacacgtgctacaatggctggcaacgagtcgcaagccggtgacggcaagctaatctcttccagtctcagttcggatgtaggctgcaactcgcctacagaagtcggaatcgctagtaatcgcggatcagcacgccgcggtgaatacgttcccgggccttgtacacaccgcccgtcacaccacgagagtttgtaacacccgaagtcggtaggtagccagccgcctaaggtgggatagatgattggggtgaagtcgtaacaaggtagccgtatcggaaggtgcggctggaacacctcctt

SEQ ID NO: 1866 - DNA, 1262 bp, Streptococcus sp.
  oral clone ASCE10
  modified_base (1065)..(1065): a, c, t, g, unknown or other
  modified_base (1065)..(1065): a, c, t, g, unknown or other
  modified_base (1067)..(1067): a, c, t, g, unknown or other
  modified_base (1067)..(1067): a, c, t, g, unknown or other
  modified_base (1137)..(1137): a, c, t, g, unknown or other
  modified_base (1137)..(1137): a, c, t, g, unknown or other
  modified_base (1223)..(1223): a, c, t, g, unknown or other
  modified_base (1223)..(1223): a, c, t, g, unknown or other
  modified_base (1250)..(1250): a, c, t, g, unknown or other
  modified_base (1250)..(1250): a, c, t, g, unknown or other
ggagtttgattctggctcaggacgaacgctggcggcgtgcctaatacatgcaagtagaacgagttgcgaacgggtgagtaacgcgtaggtaacctgcctggtagcgggggataactattggaaacgatagctaataccgcataacaaaagtcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagatgacggtatcttaccagaaagggacggctaactacgtgccagctgccgcggtaatacgtaggtcccgagcgttgtccggatttattgggcgtaaagcgagcgcaggcggttagataagtctgaagttaaaggctgtggcttatccatagtacgctttggaaactgtttaacttgagtgcaagaggggagagtggaattccatgtgtagcggtgaaatgcgtagatatatggaggaacaccggtggcgaaagcggctctctggcttgactgacgctgaggctcgaaagcgtggggagcaaacaggattagataacctggtagtccacgccgtaaacgatgagtgctaggtgttagacgtttagtgccgcagctaacgcattaagcactccgcctggggagtacgaccgcaaggtggaaactcaaaggaattgacgggggcccgcacaagcggtggagcatgtggtttaattcgaagcaacgcgaagaaccttatccagtcttgacatcgacaggtggtgcatggttgtcgtcagctcgtgtcgtgagatgttgggttaagtcccgcaacgagcgcaacccctattgttagttcccatcatgggcactctagcgagactgccggtaataaaccggaggaaggtggggatgacgtcaaatcatcatgccccttatgactggaancncacacgtgctacaatggctggcaacgagtcgccaaccggtgacggcaagctaatctcttccagtctcagntcggatgtaggctgcaactcgcctacagaagtcggaatcgctagtaatcgcggatcagcacgccgcggtgaatacgttcccgggcnttgtacacgccgcccgtcacccccccngagtttgtaaca

SEQ ID NO: 1867 - DNA, 1362 bp, Streptococcus sp.
  oral clone ASCE12
  modified_base (587)..(587): a, c, t, g, unknown or other
  modified_base (587)..(587): a, c, t, g, unknown or other
ggagtttgattctggctcaggacgaacgccggcggcgtgcctaatacatgcaagtagaacgagttgcgaacgggtgagtaacgcgtaggtaacctgcctggtagcgggggataactattggaaacgatagctaataccgcataaaaaagtcactaccagatggacctgcgttgtattagctagttggtggggtaacggctcaccaaggcgacgatacatagccgacttgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagatgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgngtagcggtgaaatgcgtaatatatggaggaacaccggtggcgaaagcggctctctggcttgactgacgctgaggctcgaaagcgtggggagcaaacaggattagataccctggtagtccacgccgtaaacgatgagtgctaggtgttagacgtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccctattgttagttgccatcatgggcactctagcgagactgccggtaataaaccggaggaaggtggggatgacgtcaaatcatcatgccccttatgacctgggctacacacgtgctacaatggctggcaacgagtcgcaagccggtgacggcaagctaatctcttccagtctcagttcggatgtaggctgcaactcgcctacagaagtcggaatcgctagtaatcgcggatcagcacgccgcggtgaatacgttcccgggccttgtacacaccgcccgtcacaccacgagagtttgtaacacccgaagtcggtaggtagccagccgcctaaggtgggatagatgattggggtgaagtcgtaacaaggtagccgtatcggaaggtgcggctggaacacctcctt

SEQ ID NO: 1868 - DNA, 1364 bp, Streptococcus sp.
  oral clone ASCF05
  modified_base (1014)..(1014): a, c, t, g, unknown or other
  modified_base (1014)..(1014): a, c, t, g, unknown or other
  modified_base (1206)..(1206): a, c, t, g, unknown or other
  modified_base (1206)..(1206): a, c, t, g, unknown or other
  modified_base (1336)..(1336): a, c, t, g, unknown or other
  modified_base (1336)..(1336): a, c, t, g, unknown or other
  modified_base (1338)..(1338): a, c, t, g, unknown or other
  modified_base (1338)..(1338): a, c, t, g, unknown or other
  modified_base (1355)..(1355): a, c, t, g, unknown or other
  modified_base (1355)..(1355): a, c, t, g, unknown or other
ggagtttgatcatggctcaggacgaacgctggcggcgtgcctaatacatgcaagtagaacgagttgcgaacgggtgagtaacgcgtaggtaacctgcctggtagcggaggataactattggaaacgatagctaataccgcataacaaaagtcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagatgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgactgacgctgaggctcgaaagcgtggggagcaaacaggattagataccctggtagtccacgccgtaaacgatgagtgctaggtgttagacgtttagtgccgcagctaacgcattaagcactccgcctggggagtacgaccgcaaggttgaaactcaagggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccctattgttagttgccatcatgggcactctagcgagactgccggtaataaancggaggaaggtggggatgacgtcaaatcatcatgccccttatgacctgggctacacacgtgctacaatggctggcaacgagtcgcaagtcggtgacggcaagctaatctcttccagtctcagttcggatgtaggctgcaactcgcctacagaagtcggaatcgctagtaatcgcggatcagcacgccgcggnaaatacgttcccgggccttgtacacaccgcccgtcacaccacgagagtttgtaacacccgaagtcggtaggtagccagccgcctaaggtgggatagatgattggggtgaagtcgtaacaaggtagccggntnggaaggtgcggctaaancacctcctt

SEQ ID NO: 1869 - DNA, 1364 bp, Streptococcus sp.
  oral clone ASCF07
  modified_base (232)..(232): a, c, t, g, unknown or other
  modified_base (232)..(232): a, c, t, g, unknown or other
  modified_base (657)..(657): a, c, t, g, unknown or other
  modified_base (657)..(657): a, c, t, g, unknown or other
  modified_base (1122)..(1122): a, c, t, g, unknown or other
  modified_base (1122)..(1122): a, c, t, g, unknown or other
ggagtttgattctggctcaggatgaacgctggcggcgtgcctaatacatgcaagtagaacgagttgcgaacgggtgagtaacgcgtaggtaacctgcctcttagcgggggataactattggaaacgatagctaataccgcataagaaagtcactaagagatggacctgcgttgtattagctagttggtgaggtaacggctcaccaaggcgacgatacatagccgacctgagngggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagatgacggtaacttaccagaaagggacggctaactacgtgccagcagccgcggtaatacgtaggtcccgagcgttatccggatttattgggcgtaaagcgagcgcaggcggttagataagtctgaagttaaaggctgtggcttaaccatagctacgctttggaaactgtttaacttgagtgcagaaggggagagtggaattccatgtgtagcggtgaaatgcgtagatatatggaggaacaccggtggcgaaagcggctctctggtctgactgacnctgaggctcgaaagcgtggggagcaaacaggattagataccctggtagtccacgccgtaaacgatgagtgctaggtgttgggtactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccctattgttagttgccatcatgggcactctagcgagactgccggtaataaaccggaggaaggtggggatgacgtcaaatcatcatgccccttatgacctgggctacacacgtgctacaatggctggcaacgagtcgcgagtcggtgacggcaagctaatntcttccagtctcagttcggatgtaggctgcaactcgcctacagaagtcggaatcgctagtaatcgcggatcagcacgccgcggtgaatacgttcccgggccttgtacacaccgcccgtcacaccacgagagtttgtaacacccgaagtcggtaggtagccagccgcctaagatgggatagatgattggggtgaagtcgtaacaaggtagccgtatcggaaggtgcggttggaacacctcctt

SEQ ID NO: 1870 - DNA, 1357 bp, Streptococcus sp.
  oral clone ASCF09
  modified_base (787)..(787): a, c, t, g, unknown or other
  modified_base (787)..(787): a, c, t, g, unknown or other
ggagtttgattctggctcaggacgaacgctggcggcgtgcctaatacatgcaagtagaacgagttgcgaacgggtgagtaacgcgtaggtaacctgcctggtagcgggggataactattggaaacgatagctaataccgcataataaaagccactaccagatggacctgcgttgaattagctagttggtggggtaacggctcaccaaggcgacgatacatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaagctctgttgtaagagaagatgacggtatcttaccagaaagggacggctaactacgtgccagcagccgcggtaatacgtaggtcccgagcgtgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcgactctctggcttgactgacgctgaggctcgaaagcgtggggagcaaacaggattagataccccggtaatccacgccgtaaacaatgagtgctaggtgttagacgtttagtgccgtagctaacgcattaagcactccgcctggggagtacgnccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccctatagttagttgccatcatgggcactctagcgagactgccggtaataaaccggaggaaggtggggatgacgtcaaatcatcatgccccttatgacctgggctacacacgtgctacaatggctggcaacgagtcgcaagtcggtgacggcaagctaatctcttccagtctcagttcggatgtaggctgcaactcgcctacagaagtcggaatcgctagtaatcgcggatcagcacgccgcggtgaatacgttcccgggccttgtacacaccgcccgtcacaccacgagagtttgtaacacccgaagtcggtaggtagccagccgcctaaggtgggatagatgattggggtgaagtcgtaacaaggtagccgtatcggaaggtgcggctggaacac

SEQ ID NO: 1871 - DNA, 1549 bp, Streptococcus sp.
  oral clone ASCG04
  modified_base (630)..(630): a, c, t, g, unknown or other
  modified_base (630)..(630): a, c, t, g, unknown or other
  modified_base (782)..(782): a, c, t, g, unknown or other
  modified_base (782)..(782): a, c, t, g, unknown or other
  modified_base (901)..(901): a, c, t, g, unknown or other
  modified_base (901)..(901): a, c, t, g, unknown or other
  modified_base (1305)..(1305): a, c, t, g, unknown or other
  modified_base (1305)..(1305): a, c, t, g, unknown or other
tgctcatggctcaggacgaacgctggcggcgtgcctaatacatgcaagtagaacgctgaaggaggagcttgctcttctggatgagttgcgaacgggtgagtaacgcgtaggtaacctgcctggtagcgggggataactattggaaacgatagctaataccgcataatattgactattgcatgatagtcaattgaaaggtgcaaatgcaccactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttgngaaactgttaaacttggagtgcagaaggggagagtggaattcccatatgtagcggtaaaatgcgtagatatatgggaggaaccaccgctgggcgaaagcggctatctggtctgtgaactgacgctgagggctcgaaagcgtggggagcaaancaggattagataccacgggtagtccacgccgtaaacgatgagtgctaggtgttgggtcctttccgggactcagtgccgcagctaacgcattaagcactccgcctggggagtacgaccgncaaggttgaaactcaaaggaattgaccgcgggcccgcacaagcggtggagcatgtggtttaattcgaagcaacgcgaagaaccttaccaggtcttgacatcccggtgcccgtcctagagataggattttgcttcggcacacccggtgacaggtgggtgcatggttgtcgtcagctcgtgtcgtgagaatgttgggttaagtcccgcaacgagcgcaacccttattactagttgccagcattgagttgggcactctagtgagactgccggtgacaaaccggaggaaggtggggatgacgtcaaatcatcatgccccttatgacttgggctacacacgtgctacaatggatggtacaacgagcagcgaactcgcgagggtaagcgaatctcttaaagccattctcngttcggattgtaggctgcaactcgcctacatgaagccggaatcgctagtaatcgtggatcagcacgccgcggtgaatacgttcccgggtcttgtacacaccgcccgtcacaccacgagagtttgtaacacccaaagtcggtgaggtaacctttatggagccagccgcctaaggtgggatagatgattggggtgaagtcgtaacaaggtagccgtatcggaaggtgcggctggatcacctccttc

SEQ ID NO: 1872 - DNA, 1540 bp, Streptococcus sp.
  oral clone BW009
gagagtttgatyctggctcaggacgaacgctggcggcgtgcctaatacatgcaagtagaacgctgaaggaggagcttgcttctctggatgagttgcgaacgggtgagtaacgcgtaggtaacctgcctggtagcgggggataactattggaaacgatagctaataccgcataatattgattattgcatgatagtcaattaaaaggtgcaattgcatcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgtagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatggcctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccatttggagccagccgcctaaggtgggatagatgattggggtgaagtcgtaacaaggtagccgtatcggaaggtgcggctggatcacctccttc

SEQ ID NO: 1873 - DNA, 1541 bp, Streptococcus sp.
  oral clone CH016
gagagtttgattctggctcaggacgaacgctggcggcgtgcctaatacatgcaagtagaacgctgaaggaggagcttgcttctctggatgagttgcgaacgggtgagtaacgcgtaggtaacctgcctggtagcgggggataactattggaaacgatagctaataccgcgtaaaattgattattgcatgatagtcaattaaaaggtgcaattgcatcactaccagatggacctgcgttgtattagctagttggtgaggtaacggctcaccaaggcaacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgcaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctccgaccgctctagagatagagttttccttcgggacagaggtgacaggtggtgcatggttgtcgtcagctcgtgtcgtgagatgttgggttaagtcccgcaacgagcgcaacccctattgttagttgccatcatttagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctccttc

SEQ ID NO: 1874 - DNA, 1363 bp, Streptococcus sp.
  oral clone GK051
gagtttgattctggctcaggatgaacgcaggcggcgtgcctaatacatgcaagtagaacgagttgcgaacgggtgagtaacgcgtaggtaacctgcctggtagtgggggataactattggaaacgatagctaataccgcataatgaaagtcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaagctctgttgtaagagaagatgacggtatcttaccagaaagggacggctaactacgtgccagcagccgcggtaatacgtaggtcccgagcgttgtccggatttattgggcgtaaagcgagcgcagacggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgactgacgctgaggctcgaaagcgtggggagcaaacaggattagataccctggtagtccacgccgtaaacgatgagtgctaggtgttagacgtttagtgccgtagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccctactgttagttgccatcatgggcactctagcgagactgccggtaataaaccggaggaaggtggggatgacgtcaaatcatcatgccccttatgacctgggctacacacgtgctacaatggctggcaacgagtcgcaagtcggtgacgacaagctaatctcttccagtctcagttcggatgtaggctgcaactcgcctacagaagtcggaatcgctagtaatcgcggatcagcacgccgcggtgaatacgttcccgggccttgtacacaccgcccgtcacaccacgagagtttgtaacacccgaagtcggtaggtagccagccgcctaaggtgggatagatgattggggtgaagtcgtaacaaggtagccgtatcggaaggtgcggctggaacacctcctt

SEQ ID NO: 1875 - DNA, 1363 bp, Streptococcus sp.
  oral clone GM006
gagtttgattctggctcaggacgaacgctggcggcgtgcctaatacatgcaagtagaacgagttgcgaacgggtgagtaacgcgtaggtaacctgcctggtagcgggggataactattggaaacgatagctaataccgcataacaaaagccactaccagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatggacggaagtctgaccgagcaaccccgcgtgagtgaagaaggttttcggatcgtaaaactctgttgttagagaagatgacggtatctaaccagaaagacacggctaactacgtgccagcagccgcggtaatacgtaggtggcaagcgttgtccggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgactgacgctgaagctcgaaagcggggggagcaaacaggattagataccctggtagtccacgccgtaaacgatgagtgctaggtgttgggtactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccctattgttagttgccatcatgggcactctagcgagactgccggtaataaaccggaggaaggtggggatgacgtcaaatcatcatgccccttatgacctgggctacacacgtgctacaatggctggcaacgagtcgcaagccggtgacggcaagctaatctcttccagtctcagttcggatgtaggctgcaactcgcctacagaagtcggaatcgctagtaatcgcggatcagcacgccgcggtgaatacgttcccgggccttgtacacaccgcccgtcacaccacgagagtttgtaacacccgaagtcggtaggtagccagccgcctaaggtgggatagatgattggggtgaagccgtaacaaggtagccgtatcggaaggtgcggctggaacacctcctt

SEQ ID NO: 1876 - DNA, 1324 bp, Streptococcus sp.
  oral clone P2PA_41 P2
gacgaacgctggcggcgtgcctaatacatgcaagtagaacgagttgcgaacgggtgagtaacgcgtaggtaacctgcctggtagcgggggataactattggaaacgatagctaataccgcataatgaaagtcactaccagatggacctgcgttgtattagctagttggtgaggtaacggctcaccaaggcaacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagatgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgactgacgctgaggctcgaaagcgtggggagcaaacaggattagataccctggtagtccacgccgtaaacgatgagtgctaggtgttagacgtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccctattgttagttgccatcatgggcactctagcgagactgccggtaataaaccggaggaaggtggggatgacgtcaaatcatcatgccccttatgacctgggctacacacgtgctacaatggctggcaacgagtcgcaagccggtgacggcaagctaatctcttccagtctcagttcggatgtaggctgcaactcgcctacagaagtcggaatcgctagtaatcgcggatcagcacgccgcggtgaatacgttcccgggccttgtacacaccgcccgtcacaccacgagagtttgtaacacccgaagtcggtaggtagccagccgcctaaggtgggatagatgattggggtgaagtcgtaacaaggtagccgtatcggaagg

SEQ ID NO: 1877 - DNA, 1324 bp, Streptococcus sp.
  oral clone P4PA_30 P4
gacgaacgttggtggcgtgcctaatacatgcaagtagaacgagttgcgaacgggtgagtaacgcgtaggtaacctgcctggtagcgggggataactattggaaacgatagctaataccgcataaagaaagtcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagcgaagaaggttttcggatcgtaaagctctgttgtaagagaagatgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgactgacgctgaggctcgaaagcgtggggagcaaacaggattagataccctggtagtccacgccgtaaacgatgagtgctaggtgttagacgtttagtgccgcagctaacgcattaagcactccgcctggggagtacgacgcaggtgaaactcaaaggaattgacgggggcccgcacaagcggtggagcatgtggtttaattcgaagcaacgcgaagaaccttaccaggtcttgacatcgactggtggtgcatggttgtcgtcagcttgtgtcgtgagatgttgggttaagtcccgcaacgagcgcaacccctattgttagttgccatcatgggcactctagcgagactgccggtaataaaccggaggaaggtggggatgacgtcaaatcatcatgccccttatgacctgggctacacacgtgctacaatggctggcaacgagtcgcaagccggtgacggcaagctaatctcttccagtctcagttcggatgtaggctgcaactcgcctacagaagtcggaatcgctagtaatcgcggatcagcacgccgcggtgaatacgttcccgggccttgtacacaccgcccgtcacaccacgagagtttgtaacacccgaagtcggtaggtagccagccgcctaaggtgggatagatgattggggtgaagtcgtaacaaggtagccgtatcggaaggtgc

SEQ ID NO: 1878 - DNA, 1546 bp, Streptococcus sp.
  oral taxon 071
tgagagtttgatcctggctcaggacgaacgctggcggcgtgcctaatacatgcaagtagaacgctgaagagaggagcttgctcttcttggatgagttgcgaacgggtgagtaacgcgtaggtaacctgcctggtagcgggggataactattggaaacgatagctaataccgcataaaatggattatcgcatgatgattcattgaaaggtgcaaatgcatcactaccagatggacctgcgttgtattagctagttggtggggtaacggctcaccaaggcaacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgatcgctctagagatagagctttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgtggctggatcacctcctttct

SEQ ID NO: 1879 - DNA, 1203 bp, Streptococcus sp.
  oral taxon G59
gatgtacgctggcggcgtgcctgatacatgcaagtagcacgctgaagcttaggtgcttgcaccgagcggatgagttgcgaaccggggtgaggtcaaacggcggtagggtaaaccttgcccttcttagcgggggatatactaatgtgtgaaaacgaatagcttaatacccgcatcataagagactgatatcgcatgatattgatttgaaagatgcaattgcatcagctaagagatggacctgtgttgtattagctagttggtgaggtaacggctgcaccaaggcaacgatacatagccgacctgagagggtgatcggccacactgggactgagacacggcccagactcgtacgggaggcagcagtagggtatcttcggcaatgggggcaaccctgaaccgagcaacgccgcgtgagtgaagaaggttttcggatcgtaaagctctgttgtaagagaagaacgagtgtgagagtggaaagttcacactgtgacggtaacttaccagaaagggacggctaactacgtgccagcagccgcggtaatacgtaggtcccgagcgttatccggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtgtaattcgaagcaacgcgaagaaccttaccatgtcttgacatccctctgaccgctctagagatagagtgtcgcttcgggacagaggtgacaggtggtgcatgggtgtcgtcagctcgtgtcgtgagatgtggggttaagtccgcaacgagcgcacccctatgatagtgccatcattacgtgggcactctagcgaactgcgggtattaacccgaggaagggtgggaatacgtcaatatatg

SEQ ID NO: 1880 - DNA, 1216 bp, Streptococcus sp.
  oral taxon G62
gacgaacgctggcggcgtgcctaatacatgcaagtggaacgctgaagagaggagcttgctcttcttggatgagttgcgaacgggtgagtaacgcgtaggtaacctgcctggtagcgggggataactattggaaacgatagctaataccgcatgaaatggattatcgcatgataatcgattgaaaggtgcaaatgcatcactaccagatggacctgcgttgtattagctagttggtgaggtaacggctcaccaaggcaacgatacatagccgacctgagagggtgatcggccacactggggctgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgcaactgacgctgaggctcgaaagcgtggggagcaaacaggattaggtaccctggtagtccacgccgtaaacgatgagtgctaggtgttagaccctttccggggtttagtgccgcagctaacgcattaagcactccgcctggggagtacgaccgcaaggttgaaactcaaaggaatagacgggggcccgcacaagcggtggagcatgtggtttaattcgaagcaacgcgaagaacctaccaggtcttgacatccctctgaccgctctagagatagagttttccctcgggacagaggtgacagggtggtgcatgggttgtcgtcagctcgtgtcgtgagatgtcggggttaggtccgccacgagcgcacccctattgttgttgccatcattagttgggcaccctagcggactgccggtatttacccgaaggagggtggggattacgtcaagttactatgccccctatgatcggggctacacgagtcctacatg

SEQ ID NO: 1881 - DNA, 1204 bp, Streptococcus sp.
  oral taxon G63
gacgtacgctggcggtgtgcctgatacatgcaagtagcacgctgaagagaggtgcttgctcttcttggatgagttgcgaacgggtgagtcacgcgtaggtaacctgcctgatagcgggggctaactattgtaaacgatagctaataccgcatgaaatggattatcgcatgataatcgattgaaaggtgcagatgcatcactaccagatggacctgcgttgtattagctagttggtgaggtaacggctcaccacggcaacgatacatagccgacctgagagggtgatcggccacactgggactgagacacggccccagacacgtacggggaggcagcagtagggtatcttcggcaatggacggaagtactgaccgagcaacgccgcgtgagtgaagaaggtgttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgcagctaacgcattaagcactccgcctggggagtacgaccgcaaggtggaaactcaaaggaattgacgggggcacgcacaagcggtggagcatgtggtttaattcgaagcaacgcgaagaaccttaccaggtcttgacatccctctgaccgctctagagatagagttttccctcgggacagaggtgacagggtggtgcatgggttgtcgtcagccgtgtcgtgagatgttcgggttaagtccgccacgagcgccacccctattgttagttgcccatcatttaggtgggtcaccttagcgagactgcccggtattaaccggagggagggtgggaatacgtcaaatatcatgccccttatacgtgg

SEQ ID NO: 1882 - DNA, 1547 bp, Streptococcus suis
tgagagtttgatcctggctcaggacgaacgctggcggcgtgcctaatacatgcaagtagaacgctgaagtctggtgcttgcactagacggatgagttgcgaacgggtgagtaacgcgtaggtaacctgcctcatagcgggggataactattggaaacgatagctaataccgcataacagtatttaccgcatggtagatatttgaaaggagcaattgcttcactatgagatggacctgcgttgtattagctagttggtgaggtaacggctcaccaaggcttcgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaactgtgagaagagtggaaagtttctcacttgacggtatcttaccagaaagggacggctaactacgtgccagcagccgcggtaatacgtaggtcccgagcgttgtccggatttattgggcgtaaagcgagcgcaggcggtttgataagtctgaagtaaaaggctgtggcttaaccatagtacgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgaccgccctagagatagggtttctcttcggagcatcggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttcta

SEQ ID NO: 1883 - DNA, 1012 bp, Streptococcus thermophilus; identical to SEQ ID NO: 1826
  modified_base (998)..(998): a, c, t, g, unknown or other
  modified_base (998)..(998): a, c, t, g, unknown or other
  modified_base (1005)..(1006): a, c, t, g, unknown or other
  modified_base (1005)..(1006): a, c, t, g, unknown or other

SEQ ID NO: 1884 - DNA, 1431 bp, Streptococcus uberis
agtagaacgctgaggactggtgcttgcactggtctaaggagttgcgaacgggtgagtaacgcgtaggtaacctacctcatagcgggggataactattggaaacgatagctaataccgcatgacaatagggtacacatgtaccctatttaaaaggggcaaatgcttcactatgagatggacctgcgttgtattagctagttggtaaggtaacggcttaccaaggcgacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgttagagaagaacggtaatgggagtggaaaatccattacgtgacggtaactaaccagaaagggacggctaactacgtgccagcagccgcggtaatacgtaggtcccgagcgttgtccggatttattgggcgtaaagcgagcgcaggcggtttgataagtctgaagttaaaggctgtggcttaaccatagttcgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccggagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgcccgctctagagatagagctttacttcggtacatcggtgacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaacctattaggagccagccgcctaaggtgggatagatga

SEQ ID NO: 1885 - DNA, 1466 bp, Streptococcus urinalis
cgctggcggcgtgcctaatacatgcaagtagaacgctgaggtcatgtgcttgcacaagaccaaggagttgcgaacgggtgagtaacgcgtaggtaacctgcctcatagcgggggataactattggaaacgatagctaataccgcatgagagtttttaacacatgttaggaacttaaaaggagcaactgcttcactatgagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgttagagaagaatggaagtaggagtggaaagtctacttcgtgacggtaactaaccagaaagggacggctaactacgtgccagcagccgcggtaatacgtaggtcccgagcgttgtccggatttattgggcgtaaagcgagcgcaggcggttctataagtctgaagttaaaggcagtggctcaaccattgttcgctttggaaactgtagaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgcccgctctagagatagagttttacttcggtacatcggagacaggtggtgcatggttgtcgtcagctcgtgtcgtgagatgttgggttaagtcccgcaacgagcgcaacccctattgttagttgccatcattcagttgggcactctagcaagactgccggtaataaaccggaggaaggtggggatgacgtcaaatcatcatgccccttatgacctgggctacacacgtgctacaatggttggtacaacgagtcgcaagtcggtgacgacaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtga

SEQ ID NO: 1886 - DNA, 1043 bp, Streptococcus vestibularis
  modified_base (925)..(925): a, c, t, g, unknown or other
  modified_base (925)..(925): a, c, t, g, unknown or other
  modified_base (932)..(932): a, c, t, g, unknown or other
  modified_base (932)..(932): a, c, t, g, unknown or other
  modified_base (942)..(942): a, c, t, g, unknown or other
  modified_base (942)..(942): a, c, t, g, unknown or other
  modified_base (978)..(978): a, c, t, g, unknown or other
  modified_base (978)..(978): a, c, t, g, unknown or other
  modified_base (1005)..(1007): a, c, t, g, unknown or other
  modified_base (1005)..(1007): a, c, t, g, unknown or other
  modified_base (1019)..(1019): a, c, t, g, unknown or other
  modified_base (1019)..(1019): a, c, t, g, unknown or other
  modified_base (1024)..(1024): a, c, t, g, unknown or other
  modified_base (1024)..(1024): a, c, t, g, unknown or other
  modified_base (1027)..(1028): a, c, t, g, unknown or other
  modified_base (1027)..(1028): a, c, t, g, unknown or other
agaacgctgaagagaggagcttgctcttcttggatgagttgcgaacgggtgagtaacgcgtaggtaacctgccttgtagcgggggataactattggaaacgatagctaataccgcataacaatggatgacacatgtcatttatttgaaaggggcaattgctccactacaagatggacctgcgttgtattagctagtaggtgaggtaacggctcacctaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagtcaagaacgagtgtgagagtggaaaattcacactgtgacggtagcttaccagaaagggacggctaactacgtgccagcagccgcggtaatacgtaggtcccgagcgttgtccggatttattgggcgtaaagcgagcgcaggcggtttgataagtctgaagttaaaggctgtggctcaaccatagttcgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttggatcctttccgggattcagtgccgcagctaacgcattaagcactccgcctggggagtacgaccgcaaggttgaaactcaaaggaattgacgggggcccgcacaagcggtggagcatgtggtttaatttcgaagcaacgcgaagaancttaccnggtcttgacntcccgatgctatttctagagatagaaagttacttcngtacatcggtgacaggtggtgcatggnnntcgtcagctcgngtcgngannatgttgggttaagtc

SEQ ID NO: 1887 - DNA, 1195 bp, Streptococcus viridans
gagtttgatcctggctcaggacgaacgctggcggcgtgcctaatacatgcaagtagaacgcacagtttataccgtagcttgctacaccatagactgtgagttgcgaacgggtgagtaacgcgtaggtaacctgcctggtagcgggggataactattggaaacgatagctaataccgcataatattaattattgcatgataattaattgaaaggtgcaattgcaccactaccagatggacctgcgttgtactagctagtaggtgaggtaacggctcacctaggcgacgatacatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaagctctgttgttagagaagaacgggtgttagagtggaaagttcacactgtgacggtatcttaccagaaagggaccgctaactaagtgccagcagccgcggtaatacgtaggtcccgagcgttgtccggatttattgggcgtaaacgagcgcagccggttagataagtctgaagttaaaggctgtggcttaaccatagtacgctttggaaactgtttaacttgagtgcagaaggggagagtgaattccatgtgtagcggtaaatgcgtagatatatggaggaacaccggtggcgaaagcggctctctggtctgtaactgacgctgaggctcgagagcgtggggagcgaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgcccgctctagagatagagttttacttcggtacatcggtgacaggtggtgcatggttgtcgtcagctcgtgtcgtgaggtgttgggttaagtcccgcaacgagcgcaacccttattgttagttgccatcattcagttgggcactctagcgagactgccggtaataaaccggaggaaggtggggatgac

SEQ ID NO: 1888 - DNA, 1313 bp, Streptomyces albus
acgctggcggcgtgcttaacacatgcaagtcgaacgagtggcgaacgggtgagtaacacgtgggcaatctgccctgcactctgggacaagccctggaaacggggtctaataccggatatggaaaggcggtgcaggatgagcccgcggcctatcagcttgttggtggggtgatggcctaccaaggcgacgacgggtagccggcctgagagggcgaccggccacactgggactgagacacggcccagactcctacgggaggcagcagtggggaatattgcacaatgggcgcaagcctgatgcagcgacgccgcgtgagggatgacggccttcgggttgtaaacctctttcagcagggaagatgacggtacctgcagaagaagcaccggctaactacgtgccagcagccgcggtaatacgtagggtgcgagcgttgtccggaattattgggcgtaaagagctcgtaggcggcttgtcgcgtcggatgtgaaagcccggggcttaaccccgggtctgcattcgatacgggcaggctagagttcggcaggggagattggaattcctggtgtagcggtgaaatgcgcagatatcaggaggaacaccggtggcgaaggcggatctctgggccgactgacgctgaggagcgaaagcgtggggagcgaacaggattagataccctggtagtccacgccgtaaacgttgggcactaggtgtgggcgcgtccgtgccgcagctaacgcattaagtgccccgcctggggagtacggccgcaaggctaaaactcaaaggaattgacgggggcccgcacaagcggcggagcatgtggcttaattcgacgcaacgcgaagaaccttaccaaggcttgacatatacaggtggtgcatggctgtcgtcagctcgtgtcgtgagatgttgggttaagtcccgcaacgagcgcaacccttgtcctgtgttgccagcaattggggactcacgggagactgccggggtcaactcggaggaaggtggggacgacgtcaagtcatcatgccccttatgtcttgggctgcacacgtgctacaatggccggcaatgagctgcgatgccgtgaggtggagcgaatctcaaccggtctcagttcggatggggtctgcaactcgaccccagaagtcggagtcgctagtaatcgcagatcagcattgctgcggtgaatacgttcccgggccttgtacacaccgcccgtcacgtcacgaaagtcggtaacacccgaagccggtgcccagggaatcgtcgaaggtgggactggcgattgggacgaagtcgtaacaaggtagccg

SEQ ID NO: 1889 - DNA, 1533 bp, Streptomyces griseus
ttcacggagagtttgatcctggctcaggacgaacgctggcggcgtgcttaacacatgcaagtcgaacgatgaagcctttcggggtggattagtggcgaacgggtgagtaacacgtgggcaatctgcccttcactctgggacaagccctggaaacggggtctaataccggataacactctgtcccgcatgggacggggttaaaagctccggcggtgaaggatgagcccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgagagtgacggtacctgcagaagaagcgccggctaactacgtgccagcagccgcggtaatacgtagggcgcaagcgttgtccggaattattgggcgtaaagagctcgtaggcggcttgtcacgtcggatgtgaaagcccggggcttaaccccgggtctgcattcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacgttgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatataccggaaagcatcagagatggtgccccccttgtggtcggtatacaggtggtgcatggctgtcgtcagctcgtgtcgtgagatgttgggttaagtcccgcaacgagcgcaacccttgttctgtgttgccagcatgcccttcggggtgatggggactcacaggagactgccggggtcaactcggaggaaggtggggacgacgtcaagtcatcatgccccttatgtcttgggctgcacacgtgctacaatggccggtacaatgagctgcgatgccgcgaggcggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttctaagga

SEQ ID NO: 1890 - DNA, 1415 bp, Streptomyces sp.
  1 AIP-2009
tgcaagtcgacgatgaaccgctttcgggcggggattagtggcgaacgggtgagtaacacgtgggcaatctgccctgcactctgggacaagccctggaaacggggtctaataccggatactcactgccttgggcatccttggcggtggaaagctccggcggtgcaggatgagcccgcggcctatcagctagttggtgaggtaatggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgagagtgacggtacctgcagaagaagcgccggctaactacgtgccagcagccgcggtaatacgtagggcgcaagcgttgtccggaattattgggcgtaaagagctcgtaggcggcttgtcacgtcggttgtgaaagcccggggcttaaccccgggtctgcagtcgatacgggcaggctagagttcggtaggggagatcggaattcctggtgtagcggtgaaatgcgcagatatcaggaggaacaccggtggcgaaggcggatctctgggccgatactgacgctgaggagcgaatgcgtggggagcgaacaggattagataccctggtagtccacgccgtaaacggtgggcactaggtgtgggcaacattccacgttgtccgtgccgcagctaacgcattaagtgccccgcctggggagtacggccgcaaggctaaaactcaaaggaattgacgggggcccgcacaagcagcggagcatgtggcttaattcgacgcaacgcgaagaaccttaccaaggcttgacatacaccggaaagcattagagatagtgccccccttgtggtcggtgtacaggtggtgcatggctgtcgtcagctcgtgtcgtgagatgttgggttaagtcccgcaacgagcgcaacccttgtcccgtgttgccagcaagcccttcggggtgttggggactcacgggagaccgccggggtcaactcggaggaaggtggggacgacgtcaagtcatcatgccccttatgtcttgggctgcacacgtgctacaatggccggtacaatgagctgcgataccgcgaggtggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggaccagcgat

SEQ ID NO: 1891 - DNA, 1436 bp, Streptomyces sp.
  SD 511
  modified_base (6)..(7): a, c, t, g, unknown or other
  modified_base (6)..(7): a, c, t, g, unknown or other
  modified_base (9)..(9): a, c, t, g, unknown or other
  modified_base (9)..(9): a, c, t, g, unknown or other
  modified_base (15)..(15): a, c, t, g, unknown or other
  modified_base (15)..(15): a, c, t, g, unknown or other
  modified_base (1300)..(1300): a, c, t, g, unknown or other
  modified_base (1300)..(1300): a, c, t, g, unknown or other
atgaanncntttcgntgggggattagtggcgaacgggtgagtaacacgtgggcaatctgccctgcactctgggacaagccctggaaacggggtctaataccggatacgaccgcttcgggcatccgatggtggtggaaagctccggcggtgcaggatgagcccgcggcctatcagcttgttggtgaggtaacggctcaccaaggcgacgacgggtagccggcctgagagggcgaccggccacactgggactgagacacggcccagactcctacgggaggcagcagtggggaatattgcacaatgggcgcaagcctgatgcagcgacgccgcgtgagggatgacggccttcgggttgtaaacctctttcagcagggaagaagcgcaagtgacggtacctgcagaagaagcgccggctaactacgtgccagcagccgcggtaatacgtagggcgcaagcgttgtccggaattattgggcgtaaagagctcgtaggcggcttgtcgcgtcggatgtgaaagcccggggcttaactccgggtctgcattcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacgttgggaactaggtgtgggcgacattccacgtcgtccgtgccgcagctaacgcattaagttccccgcctggggagtacggccgcaaggctaaaactcaaaggaattgacgggggcccgcacaagcggcggagcatgtggcttaattcgacgcaacgcgaagaaccttaccaaggcttgacatacaccggaaacatccagagatgggtgcccccttgtggtcggtgtacaggtggtgcatggctgtcgtcagctcgtgtcgtgagatgttgggttaagtcccgcaacgagcgcaacccttgtcccgtgttgccagcaggcccttgtggtgctggggactcacgggagaccgccggggtcaactcggaggaaggtggggacgacgtcaagtcatcatgccccttatgtcttgggctgcacacgtgctacaatggccggtacaaagagctgcgataccgtgaggtggagcgaatctcaaaaagccggtctcagttcggattggggtctgcaactcgaccccatgaagtcggagtcgctagtaatcgcagatcaacattgctgcggtgaatacgttcccnggccttgtacacaccgcccgtcacgtcacgaaagtcggtaacacccgaaaccggtggcccaaccccttgtgggaaggagctgtccaaggtgggactggcgattgggacgaatcgtaacaaggtacctaccggaagg

SEQ ID NO: 1892 - DNA, 1447 bp, Streptomyces sp.
  SD 524
  modified_base (23)..(23): a, c, t, g, unknown or other
  modified_base (23)..(23): a, c, t, g, unknown or other
caagtgcaacgatgaaccacttnggtggggattagtggcgaacgggtgagtaacacgtgggcaatctgccctgcactctgggacaagccctggaaacggggtctaataccggatactgagcctcgcaggcatctgcggggttcgaaagctccggcggtgcaggatgagcccgcggcctatcagcttgttggtgaggtaacggctaccaaggcgacgacgggtagccggcctgagagggcgaccggccacactgggactgagacacggcccagactcctacgggaggcagcagtggggaatattgcacaatgggcgcaagcctgatgcagcgacgccgcgtgagggatgacggccttcgggttgtaaacctctttcagcagggaagaagcgcaagtgacggtacctgcagaagaagcgccggctaactacgtgccagcagccgcggtaatacgtagggcgcgagcgttgtccggaattattgggcgtaaagagctcgtaggcggcttgtcgcgtcggttgtgaaagcccggggcttaaccccgggtctgcagtcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacggtgggcactaggtgtgggcgacattccacgtcgtccgtgccgcagctaacgcattaagtgccccgcctggggagtacggccgcaaggctaaaactcaaaggaattgacgggggcccgcacaagcggcggagcatgtggcttaattcgacgcaacgcgaagaaccttaccaaggcttgacatacaccggaaagcatcagagatggtgccccccttgtggtcggtgtacaggtggtgcatggctgtcgtcagctcgtgtcgtgagatgttgggttaagtcccgcaacgagcgcaacccttgtcccgtgttgccagcaagcccttcggggtgttggggactcacgggagaccgccggggtcaactcggaggaaggtggggacgacgtcaagtcatcatgccccttatgtcttgggctgcacacgtgctacaatggccggtacaatgagctgcgataccgcgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtaccgtaccggaagg

SEQ ID NO: 1893 - DNA, 1405 bp, Streptomyces sp.
  SD 528
  modified_base (1385)..(1385): a, c, t, g, unknown or other
  modified_base (1385)..(1385): a, c, t, g, unknown or other
caagtcgaacgatgaacctccttcgggaggggattagtggcgaacgggtgagtaacacgtgggcaatctgccctgcactctgggacaagccctggaaacggggtctaataccggatacgacatcctcgggcatccgatggatgtggaaagctccggcggtgcaggatgagcccgcggcctatcagcttgttggtgaggtaacggctcaccaaggcgacgacgggtagccggcctgagagggcgaccggccacactgggactgagacacggcccagactcctacgggaggcagcagtggggaatattgcacaatgggcgcaagcctgatgcagcgacgccgcgtgagggatgacggccttcgggttgtaaacctctttcagcagggaagaagcgcaagtgacggtacctgcagaagaagcgccggctaactacgtgccagcagccgcggtaatacgtagggcgcgagcgttgtccggaattattgggcgtaaagagctcgtaggcggcttgtcgcgtcggttgtgaaagcccggggcttaaccccgggtctgcagtcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacggtgggcactaggtgtgggcaacattccacgttgtccgtgccgcagctaacgcattaagtgccccgcctggggagtacggccgcaaggctaaaactcaaaggaattgacgggggcccgcacaagcggcggagcatgtggcttaattcgacgcaacgcgaagaaccttaccaaggcttgacatacaccggaaagctctggagacagagcccccttgtggtcggtgtacaggtggtgcatggctgtcgtcagctcgtgtcgtgagatgttgggttaagtcccgcaacgagcgcaacccttgtcccgtgttgccagcaggcccttgtggtgctggggactcacgggagaccgccggggtcaactcggaggaaggtggggacgacgtcaagtcatcatgccccttatgtcttgggctgcacacgtgctacaatggccggtacaatgagctgcgataccgcgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaaccccttgtggganggagctgtcgaagtgggact

SEQ ID NO: 1894 - DNA, 1441 bp, Streptomyces sp.
  SD 534
cgatgaacccacttcggtgggggattagtggcgaacgggtgagtaacacgtgggcaatctgccctgcactctgggacaagccctggaaacggggtctaataccggatacgaccactttaggcatctgatggtggtggaaagctccggcggtgcaggatgagcccgcggcctatcagcttgttggtgaggtaacggctcaccaaggcgacgacgggtagccggcctgagagggcgaccggccacactgggactgagacacggcccagactcctacgggaggcagcagtggggaatattgcaccatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcgcgtcggatgtgaaagcccggggcttaaccccgggtctgcattcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacgttgggaactaggtgtgggcgacattccacgttgtccgtgccgcagctaacgcattaagttccccgcctggggagtacggccgcaaggctaaaactcaaaggaattgacgggggcccgcacaagcggcggagcatgtggcttaattcgacgcaacgcgaagaaccttaccaaggcttgacatacaccggaaacacccagagatgggtgcccccttgtggtcggtgtacaggtggtgcatggctgtcgtcagctcgtgtcgtgagatgttgggttaagtcccgcaacgagcgcaacccttgtcccgtgttgccagcaggcccttgtggtgctggggactcacgggagaccgccggggtcaactcggaggaaggtggggacgacgtcaagtcatcatgccccttatgtcttgggctgcacacgtgctacaatggccggtacaaagagctgcgataccgcgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgttacaaggtagccgtaccggaagg

SEQ ID NO: 1895 - DNA, 1483 bp, Streptomyces thermoviolaceus
gacgaacgctggcggcgtgcttaacacatgcaagtcgaacgatgaagccccttcgggggtggattagtggcgaacgggtgagtaacacgtgggcaatctgccctgcactctgggacaagccctggaaacggggtctaataccggatacgacacagggaggcatctcctctgtgtggaaagctccggcggtgcaggatgagcccgcggcctatcagcttgttggtgaggtaacggctcaccaaggcgacgacgggtagccggcctgagagggcgaccggccacactgggactgagacacggcccagactcctacgggaggcagcagtggggaatattgcacaatgggcgcaagcctgatgcagcgacgccgcgtgagggatgacggccttcgggttgtaaacctctttcagcagggaagaagcgcaagtgacggtacctgcagaagaagcgccggctaactacgtgccagcagccgcggtaatacgtagggcgcaagcgttgtccggaattattgggcgtaaagagctcgtaggcggcttgtcgcgtcggttgtgaaagcccggggcttaactccgggtctgcagtcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacggtgggcactaggtgtgggcagcattccacgttgtccgtgccgtagctaacgcattaagtgccccgcctggggagtacggccgcaaggctaaaactcaaaggaattgacgggggcccgcacaagcggcggagcatgtggcttaattcgacgcaacgcgaagaaccttaccaaggcttgacatacaccggaaacatccagagatgggtgcccccttgtggtcggtgtacaggtggtgcatggctgtcgtcagctcgtgtcgtgagatgttgggttaagtcccgcaacgagcgcaacccttgtcccgtgttgccagcaggcccttgtggtgctggggactcacgggagaccgccggggtcaactcggaggaaggtggggacgacgtcaagtcatcatgccccttatgtcttgggctgcacacgtgctacaatggccggtacaaagagctgcgataccgcgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgc

SEQ ID NO: 1896 - DNA, 1368 bp, Subdoligranulum variabile
  modified_base (23)..(23): a, c, t, g, unknown or other
  modified_base (23)..(23): a, c, t, g, unknown or other
  modified_base (25)..(25): a, c, t, g, unknown or other
  modified_base (25)..(25): a, c, t, g, unknown or other
  modified_base (44)..(44): a, c, t, g, unknown or other
  modified_base (44)..(44): a, c, t, g, unknown or other
  modified_base (1320)..(1320): a, c, t, g, unknown or other
  modified_base (1320)..(1320): a, c, t, g, unknown or other
gttatttcggttgaagttttcgnanggatactggtttaacttantggcgaacgggtgagtaacgcgtgagtaacctgccctggagtgggggacaacagttggaaacgactgctaataccgcataagcccacggtccggcatcggattgagggaaaaggatttattcgcttcaggatggactcgcgtccaattagctagttggtgaggtaacggcccaccaaggcgacgattggtagccggactgagaggttgaacggccacattgggactgagacacggcccagactcctacgggaggcagcagtgggggatattgcacaatgggggaaaccctgatgcagcgacgccgcgtggaggaagaaggttttcggattgtaaactcctgtcgttagggacgaatcttgacggtacctaacaagaaagcaccggctaactacgtgccagcagccgcggtaaaacgtagggtgcaagcgttgtccggaattactgggtgtaaagggagcgcaggcggaccggcaagttggaagtgaaatctatgggctcaacccataaattgctttcaaaactgctggccttgagtagtgcagaggtaggtggaattcccggtgtagcggtggaatgcgtagatatcgggaggaacaccagtggcgaaggcgacctactgggcaccaactgacgctgaggctcgaaagcatgggtagcaaacaggattagataccctggtagtccatgccgtaaacgatgattactaggtgttggaggattgaccccttcagtgccgcagttaacacaataagtaatccacctggggagtacgaccgcaaggttgaaactcaaaggaattgacgggggcccgcacaagcagtggagtatgtggttattcgaagcaacgcgaagaaccttaccaggtcttgacatccgatgcataatgcagatatgcatgaagtccttcgggacatcgagacaggtggtgcatggttgtcgtcagctcgtgtcgtgagatgttgggttaagtcccgcaacgagcgcaacccttattgccagttactacgcaagaggactctggcgagactgccgttgacaaaacggaggaaggtggggatgacgtcaaatcatcatgccctttatgacctgggctacacacgtactacaatggcgtttaacaaagagaagcaagaccgcgaggtggagcaaaactcaaaaacaacgtctcagttcagattgcaggctgcaactcgcctgcatgaagtcggaattgctagtaatcgcggatcagcatgccgcggtgaatacgttcccgggccttgtacacaccgcccntcacaccatgagagccggggggacccgaagtcggtagtctaaccgcaa

SEQ ID NO: 1897 - DNA, 1514 bp, Succinatimonas hippei
tgaagagtttgatcatggctcagattgaacgctggcggcaggcttaatacatgcaagtcgaacggtaacatagcgaaagcttgcttttgctgatgacgagtggcggacgggtgagtagtatctgggaaactgccctgaagagggggacaacagctggaaacggctgctaataccgcataaaccctgcgggggaaaggaaggcaacttccgcttcaggatgtgcccagaagggattagctagtaggtgaggtaaaggctcacctaggcgacgatctctagccggtctgagaggatgaccggccacatcgggactgagacacggcccggactcctacgggaggcagcagtagggaatattgcacaatggggggaaccctgatgcagccatgccgcgtgtgtgaagaaggccttcgggttgtaaagcactttcagcggggaggaaattaagttagacgttacccgcagaagaagcaccggctaactccgtgccagcagccgcggtaatacggagggtgcgagcgttaatcggaataactgggcgtaaagggcacgcaggcgggctgataagtaaggtgtgaaataccggggctcaacctcggggctgcattttaaactgtcagtctagagtattgcagagggagacggaattccgggtgtagcggtgaaatgcgtagatatccggaagaacaccggaggcgaaggcggtcttctgggcaaatactgacgctcaggtgcgaaagcgtggggagcaaacaggattagataccctggtagtccacgccgtaaacgatgtcgattaggagattgagcagaagcttggttttcggagcaaacgcgctaaatcgaccgcctggggagtacggccgcaaggttaaaactcaaatgaattgacgggggcccgcacaagcggtggagcatgtggtttaattcgatgcaacgcgaagaaccttacctgaccttgacatctgaggaatgcctgagagatttaggcagtgccttcgggagcctcaagacaggtgctgcatggctgtcgtcagctcgtgtcgtgagatgttgggttaagtcccgcaacgagcgcaacccttgtcctttgttgccagcgcgtgatggcgggaactcaaaggagactgccggtgacaaaccggaggaaggcagggatgacgtcaagtcatcatggcccttacggtcagggctacacacgtgctacaatggggcgtacagagggaagcgaggccgtgaggcggagcggagcccacaaagcgtcccacagttcggattggagtctgcaactcgactccatgaaggcggaatcgctagtaatcgcaaatcagaatgttgcggtgaatacgttcccgggccttgtacacaccgcccgtcacaccatgggagtggattgcaccagaagtggcttgcctaacccgtaagggagggcggttaccacggtgtggtttatgactggggtgaagtcgtaacaaggtaaccctaggggaacctggggttggatcacctcctta

SEQ ID NO: 1898 - DNA, 1391 bp, Sutterella morbirenis
cacatgcaagtcgaacggcagcacgaggagcttgctccttggtggcgagtggcgcacgggtgagtaatatatcggaacgtgtcctattgtgggggataactagccgaaaggttagctaataccgcataagacctgagggtgaaagcgggggatcttcggacctcgcgcagttggagcggccgatagccgattagctagttggtagggtaatggcctaccaaggcaacgatcggtagctggtctgagaggacgaccagccacactgggactgagacacggcccagactcctacgggaggcagcagtggggaattttggacaatgggggcaaccctgatccagccatgccgcgtgcaggatgaaggtcttcggattgtaaactgcttttgtcagggaagaaaagtttagagcgaataactctgaatgctgacggtacctgaagaataagcaccggctaactacgtgccagcagccgcggtaatacgtagggtgcaagcgttaatcggaattactgggcgtaaagcgtgcgcaggcggttctgtaagatgggtgtgaaagccccgggctcaacctgggaattgcattcatgactgcaggactagagttcaccagaggggggtggaattccaagtgtagcagtgaaatgcgtagatatttggaagaacaccgatggcgaaggcagccccctggggtgcgactgacgctcatgcacgaaagcgtggggagcaaacaggattagataccctggtagtccacgccctaaacgatgtctactggttgttggggatttatatccttggtaacgaagctaacgcgtgaagtagaccgcctggggagtacggtcgcaagattaaaactcaaaggaattgacggggacccgcacaagcggtggatgatgtggattaattcgatgcaacgcgaaaaaccttacctagccttgacatgtcgagaatcccgaagagatttgggagtgcccgcaagggaattcgaacacaggtgctgcatggctgtcgtcagctcgtgtcgtgagatgttgggttaagtcccgcaacgagcgcaacccttgtcattagttgctacgcaagagcactctaatgagactgccggtgacaaaccggaggaaggcagggatgacgtcaagtcctcatggcccttatggctagggcttcacacgtcatacaatggtcggaacagagggcagcgaagccgcgaggtggagccaatcccagaaaaccgatcgtagtccggattggagtctgcaactcgactccatgaagtcggaatcgctagtaatcgcggatcagcatgccgcggtgaatacgttcccgggtcttgtacacaccgcccgtcacaccatgggagtggggttcaccagaagacgttagtttaacc

SEQ ID NO: 1899 - DNA, 1489 bp, Sutterella parvirubra
attgaacgctggcggcatgctttacacatgcaagtcgaacggcagcacagggagcttgctcccgggtggcgagtggcgcacgggtgagtaagacatcggaacgtgtcctcttgtgggggataactacccgaaagggtggctaataccgcataagtcctgagggagaaagcgggggatcttcggacctcgcgcgagaggagcggccgatggccgattagctagttggtgaggtaaaggctcaccaaggcgacgatcggtagctggtctgagaggacgaccagccacactgggactgagacacggcccagactcctacgggaggcagcagtggggaattttggacaatgggcgaaagcctgatccagccatgccgcgtgtgggatgaaggccttcgggttgtaaaccacttttgtcagggacgaaaaggttcaggcyaataccttgaactgctgacggtacctgaagaataagcaccggctaactacgtgccagcagccgcggtaatacgtagggtgcaagcgttaatcggaattactgggcgtaaagcgtgcgcaggcggttctgtaagatagatgtgaaatccccgggcttaaccttggaattgcatttatgactgcaggactcgagtttgtcagaggggggtggaattccaagtgtagcagtgaaatgcgtagatatttggaagaacaccgatggcgaaggcagccccctgggacatgactgacgctcatgcacgaaagcgtggggagcaaacaggattagataccctggtagtccacgccctaaacgatgtctactggttgttggggacgatttggtccttggtaacgaagctaacgcgtgaagtagaccgcctggggagtacggtcgcaagattaaaactcaaaggaattgacggggacccgcacaagcggtggatgatgtggattaattcgatgcaacgcgaaaaaccttacctagccttgacatgtcggaaagctctgagagatcggagygtgcccgcaagggaatccgaacacaggtgctgcatggctgtcgtcagctcgtgtcgtgagatgttgggttaagtcccgcaacgagcgcaacccttgtcactagttgctacgaaagggcactctagtgagactgccggtgacaaaccggaggaaggtggggatgacgtcaagtcctcatggcccttatggctagggcctcacacgtcatacaatggtcggaacagagggcagcgaagccgcgaggtggagcaaatcccagaaaaccgatcgtagtccggattgcagtctgcaactcgactgcatgaagtcggaatcgctagtaatcgcggatcagcatgccgcggtgaatacgttcccgggtcttgtacacaccgcccgtcacaccatgggagtggggttcaccagaagacgtttgtctaaccgcaaggaggacggcgtccacggtgggtttcatgactggggtgaagtcgtaacaaggtagccgtaccggaagg

SEQ ID NO: 1900 - DNA, 1457 bp, Sutterella sanguinus
attgaacgctggcggcatgctttacacatgcaagtcgaacggcagcacgaggagcttgctccttggtggcgagtggcgcacgggtgagtaatatatcggaacgtgtcctattgtgggggataactagccgaaaggttagctaataccgcataagacctgagggtgaaagcgggggatcttcggacctcgcgcagttggagcggccgatagccgattagctagttggtagggtaatggcctaccaaggcaacgatcggtagctggtctgagaggacgaccagccacactgggactgagacacggcccagactcctacgggaggcagcagtggggaattttggacaatgggggcaaccctgatccagccatgccgcgtgcaggatgaaggtcttcggattgtaaactgcttttgtcagggaagaaaagtttagagcgaataactctgaatgctgacggtacctgaagaataagcaccggctaactacgtgccagcagccgcggtaatacgtagggtgcaagcgttaatcggaattactgggcgtaaagcgtgcgcaggcggttctgtaagatgggtgtgaaagccccgggctcaacctgggaattgcattcatgactgcaggactagagttcaccagaggggggtggaattccaagtgtagcagtgaaatgcgtagatatttggaagaacaccgatggcgaaggcagccccctggggtgcgactgacgctcatgcacgaaagcgtggggagcaaacaggattagataccctggtagtccacgccctaaacgatgtctactggttgttggggatttatatccttggtaacgaagctaacgcgtgaagtagaccgcctggggagtacggtcgcaagattaaaactcaaaggaattgacggggacccgcacaagcggtggatgatgtggattaattcgatgcaacgcgaaaaaccttacctagccttgacatgtcgagaatcccgaagagatttgggagtgcccgcaagggaattcgaacacaggtgctgcatggctgtcgtcagctcgtgtcgtgagatgttgggttaagtcccgcaacgagcgcaacccttgtcattagttgctacgcaagagcactctaatgagactgccggtgacaaaccggaggaaggcagggatgacgtcaagtcctcatggcccttatggctagggcttcacacgtcatacaatggtcggaacagagggcagcgaagccgcgaggtggagccaatcccagaaaaccgatcgtagtccggattggagtctgcaactcgactccatgaagtcggaatcgctagtaatcgcggatcagcatgccgcggtgaatacgttcccgggtcttgtacacaccgcccgtcacaccatgggagtggggttcaccagaagacgttagtttaaccgcaaggaggacgacgtccacggtgggcttcatgactggggtg

SEQ ID NO: 1901 - DNA, 1320 bp, Sutterella sp.
  YIT 12072
attgaacgctggcggcatgccttacacatgcaagtcgaacgagtggcgaacgggtgagtaatacatcggaacgtgtccgtttgtgggggacaaccagccgaaaggttggctaataccgcataaggaaaggcgcagacggagcggccgatgattgattagcttgttggcggggtaaaggcccaccaaggcgacgatcaatagctggtctgagaggacgaccagccacactggaactgagacacggtccagactcctacgggaggcagcagtggggaattttggacaatgggggcaaccctgatccagccatgccgcgtgcgggaagaaggccttcgggttgtaaaccgcttttgtcagggacgatgacggtacctgaagaataagcaccggctaactacgtgccagcagccgcggtaatacgtagggtgcaagcgttaatcggaattactgggcgtaaagcgtgcgcaggcggttgggtaagacagatgtgaaatccccgggcttaacctgggaactgcatttgtgactgtccgactggagtacgtcagaggggggtggaattccgcgtgtagcagtgaaatgcgtagatatgcggaagaacaccgatggcgaaggcagccccctgggacgactgacgctcatgcacgaaagcgtggggagcaaacaggattagataccctggtagtccacgccctaaacgatgtctgccggttgttggggcttcagtaacgaagctaacgcgtgaagcagaccgcctggggagtacggtcgcaagattaaaactcaaaggaattgacggggacccgcacaagcggtggatgatgtggattaattcgatgcaacgcgaaaaaccttacctagccttgacatgcacaggtgctgcatggctgtcgtcagctcgtgtcgtgagatgttgggttaagtcccgcaacgagcgcaacccttgtcatcagttgctacggcactctgatgagactgccggtgacaaaccggaggaaggtggggatgacgtcaagtcctcatggcccttatggctagggcctcacacgtcatacaatggtcggcagagggcagcgaagccgcgaggtgaagccaatcccagccgatcgtagtccggatgcagtctgcaactcgactgcagaagtcggaatcgctagtaatcgcggatcagcatgccgcggtgaatacgttcccgggtcttgtacacaccgcccgtcacaccatgggagtggggttcaccagaaggcgttgcccaaggcggcgcccacggtgggtttcatgactggggtgaagtcgtaacaaggtagtcgtaccggaagg

SEQ ID NO: 1902 - DNA, 1455 bp, Sutterella stercoricanis
ggcggcatgctttacacatgcaagtcgaacggcagcacagggagcttgctcctgggtggcgagtggcgcacgggtgagtaatacatcggaacgtgtcctattgtgggggataactgtcggaaagggtggctaataccgcataagacctgagggtgaaagcgggggatcgcaagacctcgcgcaattggagcggccgatgcccgattagctagttggtgaggtaatagcttaccaaggcgacgatcggtagctggtctgagaggacgaccagccacactgggactgagacacggcccagactcctacgggaggcagcagtggggaattttggacaatgggggcaaccctgatccagccatgccgcgtgcaggatgaaggtcttcggattgtaaactgcttttgtcagggacgaaaaggattgtgctaataccatgatctgctgacggtacctgaagaataagcaccggctaactacgtgccagcagccgcggtaatacgtagggtgcaagcgttaatcggaattactgggcgtaaagcgtgcgcaggcggttctgtaagacagatgtgaaatccccgggctcaacctgggaattgcatttgtgactgcaggactagagttcatcagaggggggtggaattccaagtgtagcagtgaaatgcgtagatatttggaagaacaccaatggcgaaggcagccccctgggatgcgactgacgctcatgcacgaaagcgtggggagcaaacaggattagataccctggtagtccacgccctaaacgatgtctactggttgttggggattaatatccttggtaacgaagctaacgcgtgaagtagaccccctggggagagcggtcgcaagattaaaactcaaaggaattgacggggacccgcacaagcggtggatgatgtggattaattcgatgcaacgcgaaaaaccttacgtagccttgacatgccaggaatcctgaagagatttgggagtgcccgcaagggaatctggacacaggtgctgcatggctgtcgtcagctcgtgtcgtgagatgttgggttaagtcccgcaacgagcgcaacccttgtcattagttgctacgcaagagcactctaatgagactgccggtgacaaaccggaggaaggtggggatgacgtcaagtcctcatggcccttatggctagggcctcacacgtcatacaatggtcggaacagagggcagcgaagccgcgaggtggagcaaatcccagaaaaccgatcgtagtccggattgcagtctgcaactcgactgcatgaagtcggaatcgctagtaatcgcggatcagcatgccgcggtgaatacgttcccgggtcttgtacacaccgcccgtcacaccatgggagtggggttcaccagaagacgtttgtctaaccgtaaggaaggacggcgtccacggtgggtttcatgactggggtgaagtcgt

SEQ ID NO: 1903 - DNA, 1537 bp, Sutterella wadsworthensis
ttgaactaaagagtttgatcctggctcagattgaacgctggcggcatgctttacacatgcaagtcgaacggcagcgcggggagcttgctccctggcggcgagtggcgcacgggtgagtaatacatcggaacgtgtcttctagtgggggataactgcccgaaagggcagctaataccgcatgagacctgagggtgaaagcgggggatcgcaagacctcgcgctggaagagcggccgatgtccgattagctagttggtgaggtaaaggctcaccaaggcgacgatcggtagctggtctgagaggacgaccagccacactgggactgagacacggcccagactcctacgggaggcagcagtggggaattttggacaatgggggcaaccctgatccagccatgccgcgtgcaggatgaaggtcttcggattgtaaactgcttttgtcagggacgaaaagggatgcgataacaccgcattccgctgacggtacctgaagaataagcaccggctaactacgtgccagcagccgcggtaatacgtagggtgcaagcgttaatcggaattactgggcgtaaagcgtgcgcaggcggttctgtaagatagatgtgaaatccccgggctcaacctgggaattgcatatatgactgcaggacttgagtttgtcagaggagggtggaattccacgtgtagcagtgaaatgcgtagatatgtggaagaacaccgatggcgaaggcagccctctgggacatgactgacgctcatgcacgaaagcgtggggagcaaacaggattagataccctggtagtccacgccctaaacgatgtctactagttgttggggacgatagtccttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctagccttgacatgccaggaaggtctgagagatcaggccgtgcccgcaagggaatctggacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatggctagggcctcacacgtcatacaatggtcggaacagagggaagcgaagccgcgaggtgaagccaatcccagaaaaccgatcgtagtccggattgcagtctgcaactcgactgcatgaagtcggaatcgctagtaatcgcggatcagcatgccgcggtgaatacgttcccgggtcttgtacacaccgcccgtcacaccatgggagtggggttcaccagaagacgtttgcccaaccgaaaggaaggcggcgtccacggtgggcttcatgactggggtgaagtcgtaacaaggtagccgtaccggaaggtgcggctggatcacctccttt

SEQ ID NO: 1904 - DNA, 1328 bp, Synergistes sp.
  C1
gacgaacgctggcggcgtgcttaacacatgcaagttgagcgagcagcggacgggtgagtaaagcacaaggacttgtccgaaagagagggacacctgcgggaaaccggagctaatacctaataaaaaaggcgcttttggagagacttgtgtcctatcaggcagttggtgaggtaacggctcaccaaaccgaagacgggtagccggactgagaggtcgaccggccacattggaactgagagacggtccagactcctacgggaggcagcagtggggaatattgggcaatgggcgcaagcctgacccagcgacgccgcgtgagggaagacagccttcgggttgtaaacctctgttgcaggggaagatgacggtaccctgcgaggaagctccggctaactacgtgccagcagccgcggtaatacgtagggagcgagcgttgtccggaattactgggcgtaaagggcgcgtaggcggcgcttcaagtcgtctgtcaaaagccgaggctcaacctcggtgcgcagacgaaactggagagcttgagaagcagagaggcaaacagaattcctggtgtagcggtgaaatgcgtagatatcaggaagaataccagtggcgaaggcggtttgctggctgctctaacgctgaagcgcgaaagccaggggagcaaacgggattagataccccggtagtcctggcagtaaacgatgtatgctgggtgtgggacgttccgtgccgaagttgacgcgataagcataccgcctggggagtacggtcgcaagattgaaactcaaaggaattgacgggggcccgcacaagcggtggagcacgtggtttaattcgatgcaaaccgaagaaccttacctggacttgacatcaacaggtgctgcatggctgtcgtcagctcgtgtcgtgagatgttgggttaagtcccgcaacgagcgcaacccctattgccggttgctaccagctgagcactccggcgagactgccatcgacaagatggaggaaggtggggacgacgtcaagtcatcatggcccatatgtccagggcgacacacatgctacaatggatggcagagagaagcgagaccgaaaggagaagcagatcccaaccatccccagttcggatgcagtctgcaactcgactgcagaagttggaatcgctagtaatcgcggatcagccaagccgcggtgaatacgttcccgggccttgtacacaccgcccgtcacaccatccgagtcgggtgctctcaaagccggagcctaaggatccgcctaaagagtgtccggtgaggggggtgaagtcgtaacaaggtagccgtacgggaacgtgc

SEQ ID NO: 1905 - DNA, 1412 bp, Synergistes sp.
  RMA 14551
tggcgaacgaagacctagaggagcttgctttaatatggttttagtggcggacgggtgagtaacgcgtgaggacttgtcgagtacagggggacaacaggtggaaacgtctgctaataccccataagccttcgggtaaaaggagcgatccggtacacgagagacttgtgtcctatcagctagtaggtggggtaacgagcccacccaggccaagacggatagccggactgagaggtcgatcggccacactggaactgagacacggtccagactcctacgggaggcagcagtggggaatattgggcaatgggggcaaccctgacccagcgacgccgcgtgagkgaagamakccytcgggwtgtaaamctctgttgcwgtgggaagataggacgtgacggtaccactrcgaggaagccccggcaaactacgtgccagcagccgcggtaatacgtagggagcgagcgttatccggaattactgggcgtaaagcggcgcgtaggctggtgttcaagtcgttcgttaaatattgaggcttaacctcaaggagctggccgaaactgagacactggagacacagagaggcaaacagaattcctggtgtagcggtgaaatgcgtagatatcaggaagaataccggtggcgaaggcggtttgcttggatgtgatctgacgcttgaagcgcgaaagccgggggagcgaacgggattagataccccggtagtcccggcagtaaactgatgtatgctgggtgtggccgtagcgatacagccgtgccgaagttaacgcgataagcataccgcctggggagtactggtcgcaagattgaaactcaaaggaattgacgggggcccgcacaagcggtggagcacgtggtttaattcgatgcaaaccgaagaaccttacctggacttgacatacacgtagtagcgaatcgaaagaggagcgaggatgtagcaatacattcagcgtgaacaggtgctgcatggcttgtcgtcagctcgtgtcgtgagatgttgggttaagtcccgcaacgagcgcaaccccttgttgccggttgctaacgcgcaaaggcgagcactccggcgagactgccatcgacaagatggaggaaggtggggacgacgtcaagtcatcatggcccttatgtccagggcgacacacatgctacaatggctggtacagagagaagcgaagccgagaggccgagcagatcccatcaaagccagtcccagttcggattgcagtctgcaactcgactgcatgaagttggaatcgctagtaatcgcggatcagccaagccgcggtgaatacgttcccgggccttgtacacaccgcccgtcacaccatccgagttgggtgctctcgaagtcggaggcttaaccgcaaggaaaagatccgcctaaagagtgtccggtg

SEQ ID NO: 1906 - DNA, 1432 bp, Synergistetes bacterium ADV897
gaagcgacgctggcggcgtgcctaacacatgcaagttgagcggagagttttcgaagaagacttcggttggaattggaaacgatcagcagcggacgggtgagtaaagcacaaggacgtatccttttgagggggacaactgcgggaaaccggagctaatagcccataagccgagaggtgaaagcgcgcaagcgcgcaagaggagcgacttgtgtcctatcaggcagttggtgaggtaagagctcaccaaaccgaagacgggtagccggactgagaggttgtacggccacattggaactgagagacggtccagactcctacgggaggcagcagtggggaatattgggcaatgggggcaaccctgacccagcgacgccgcgtgagggaagacagccttcgggttgtaaacctctgttgcaggggaagaaggacgtgacggtaccctgcgaggaagctccggctaactacgtgccagcagccgcggtaatacgtagggagcgagcgttatccggaattactgggcgtaaagggcgcgtaggcggtgtttcaagtcgttcgttaaatattgaggcttaacctcaaggagcggccgaaactgagacactggagacacagagaggcaaacagaattcctggtgtagcggtgaaatgcgtagatatcaggaagaataccggtggcgaaggcggtttgctggatgtgatctgacgctgaagcgcgaaagccgggggagcgaacgggattagataccccggtagtcccggcagtaaacgatgtatgctgggtgtggccgtagcgatacagccgtgccgaagttaacgcgataagcataccgcctggggagtacggtcgcaagattgaaactcaaaggaattgacgggggcccgcacaagcggtggagcacgtggtttaattcgatgcaaaccgaagaaccttacctggacttgacatacacgtagtagcgaatcgaaagaggagcgaggatgtatcaatgcattcagcgtgaacaggtgctgcatggctgtcgtcagctcgtgtcgtgagatgttgggttaagtcccgcaacgagcgcaacccctgttgccggttgctaacgcgcaaaggcgagcactccggcgagactgccatcgacaagatggaggaaggtggggacgacgtcaagtcatcatggcccctatgtccagggcgacacacatgctacaatggctggtacagagagaagcgaagccgagaggccgagcagatcccatcaaagccagtcccagttcggattgcagtctgcaactcgactgcatgaagttggaatcgctagtaatcgcggatcagccaagccgcggtgaatacgttcccgggccttgtacacaccgcccgtcacaccatccgagttgggtgctctcgaagtcggaggcttaaccgcaaggaaagatccgcctaaag

SEQ ID NO: 1907 - DNA, 1447 bp, Synergistetes bacterium LBVCM1157
cccggacgacgctggcggcgtgcctaacacatgcaagtcgaacgaaattacgaagaaagcttgctttaatcgtaatttagtggcggacgggtgagtaacgcgtgaggacttgtcggatacagggggacaacagatggaaacgtctgctaataccccataagccttcgggtaaaaggagcaatccggtatttgagagactcgcgttctatcagctagtaggtggggtaacggcccacctaggccaagacggatagccggactgagaggtcgaccggccacactggaactgagagacggtccagactcctacgggaggcagcagtggggaatattgggcaatgggggcaaccctgacccagcgacgccgcgtgggtgaagaaatccttcgggatgtaaagccctgttgtgtgggaagataatgacggtaccacacgaggaagccccggcaaactacgtgccagcagccgcggtaatacgtagggggcaagcgttgttcggaattactgggcgtaaagcgcacgcaggctgaccgttaagtctgtcgtcaaaggcggaggctcaacctccgttctacgatagatactgtcggtctagagtatgtgagagggaagtggaattcccggtgtagcggtgaaatgcgtagatatcgggaggaacaccagtggcgaaggcggcttcctggcacacaactgacgctcatgtgcgaaagccagggcagcgaacgggattagataccccggtagtcctggccgtaaacgatggatactgggtgtgggtgaagcagttcatccgtgccgtagttaacgcgttaagtatcccgcctggggactacggtcgcaagactgaaactcaaaggaattgacgggggcccgcacaagcggtggagcacgtggtttaattcgatgcaaaccgaagaaccttacctgggtttgacatacaagtggtactgagatgaaagttgagggactgtagcttgctacagagcttgaacaggtgctgcatggctgtcgtcagctcgtgtcgtgagatgttgggttaagtcccgcaacgagcgcaacccctatgtccagttgctaacaagtgaagttgagcactctggagagactgccgccgacaaggcggaggaaggtggggatgacgtcaagtcatcatggcctttatgcccagggcgacacacgtgctacaatggccggcacagaaggcagcttgctagtgatagttggcgaatccttaaaagccggtcccagttcggattgtagtctgcaacccgactacatgaagccggaatcgctagtaatcgcagatcagccaagctgcggtgaatacgttcccgggccttgtacacaccgcccgtcacaccacccgagttgggggcacccgatagccgcaggctataaccgcagtaagggaaagaagcgtctaaggtgcgcgcgagtaacagcatctc

SEQ ID NO: 1908 - DNA, 1474 bp, Synergistetes bacterium oral clone 03 5 D05
gacgaacgctggcggcgtgcctaatacatgcaagtagaacgctgaaggaaggagcttgctctttccggatgagttgcgaacgggtgagtaacgcgtaggtaacctgcctggtagcgggggataactattggaaacgatagctaataccgcataatagcagttattgcatgataactgtttgaaaggtgcaaatgcatcactaccagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgggagacttgagtgcagaagaggagagcggaattccatgtgtagcggtgaaatgcgtagatatatggaggaacaccagtggcgaaggcggctctctggtctgtaactgacgccgaggctcgaaagcgtggggagcaaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgcattagatcgcgtcagagatggcgtttcccttcggggctggtatacaggtggtgcatggttgtcgtcagctcgtgtcgtgagatgttgggttaagtcccgcaacgagcgcaaccctcgttctatgttgccagcacgtgatggtggggactcataggagactgccggggtcaactcggaggaaggtggggatgacgtcaaatcatcatgccccttatgtcttgggcctcacgcatgctacaatggccggtacagagggttgcgatactgtgaggtggagctaatccctaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaaccctggtggggggagccgtcgaaggtgggactggcgattgggact

SEQ ID NO: 1909 - DNA, 1453 bp, Synergistetes bacterium oral taxon 362
gatgaacgctggcggcgtgcgtaacacatgcaagttggacgacgatgccatgaagtggtaacacggaatggtatacggagtagcggacgggtgagtaaaacatgaggagctgtcctgttgagggggataacgttcggaaacggaccctaataccccataggccgagaggttaaaggcagagatgcgcgacaggaggcactcgtgtcctatcagctggttggtgaggtaacggctcaccaaggcgacgacgggtagccggcctgagagggtgaccggccacactggaactgagacacggtccagactcctacgggaggcagcagtggggaatattgggcaatgggaggaatcctgacccagcgacgccgcgtgaacgaagacggccttcgggttgtaaagttcttttatgtgggaagaatgaagtgacggtaccacatgaataagccccggctaactacgtgccagcagccgcggtaatacgtagggggcgagcgttgtccggaattactgggcgtaaagggcacgcaggctgtgcttcaagtcagctgtaaaaggatgcggcttaaccgtgttatgcagttgagactgaggtgctggaataccggagaggcaagtggaattcccagtgtagcggtgaaatgcgtagatattgggaagaacatcggtggcgaaggcgacttgctggacggtaactgacgctgaggtgcgaaagccagggtagcgaacgggattagataccccggtagtcctggccgtaaacgatgaatgctaggtgtgcgagcagagatgttggtgtgccgcagttaacgcgataagcattccgcctggggagtacggtcgcaagattgaaactcaaaggaattgacgggggcccgcacaagcggtggagcacgtggtttaattcgatgcaaaccgaagaaccttacctgggtttgacatgtatgtggtaggagatggaaacattgacgacgctgctttcgggcagtgagcatacacaggtgctgcatggctgtcgtcagctcgtgtcgtgagatgttgggttaagtcccgcaacgagcgcaacccctgcgattagttgccagcgagttaagtcgggcactctaatgggactgccatcgacaagatggaggaaggtggggatgacgtcaagtcatcatggcccttatgtccagggcgacacacgtgctacaatggccggtacagagggaagcgaggctgtgaggttgagcggatcccataaagccggtctcagtccggattgaagtctgcaattcgacttcatgaagctggaatcgctagtaatcgcagatcagccaagctgcggtgaatacgttcccgggccttgtacacaccgcccgtcacaccacccgagccgggtgtacccgaagccggtggcctaaccttatgggaggagccgtcgaaggtgtgtctggtgaggagggtgaagtcgtaa

SEQ ID NO: 1910 - DNA, 1337 bp, Synergistetes bacterium oral taxon D48
gatgaacgctggcggcgtgcgtaacacatgcaagttgaacgacggtgccatgaagtggtaacacggagtggtatacggagtagcggacgggtgagtaaagcatgagaatctgtcctgtcgagggggatagcgttcggaaacggaccctaataccccatagtccgagaggttaaaggcagcgatgcgcggcaggaggagctcgtgtcctatcagctggttggtgaggtaacggctcaccaaggcaacgacgggtagccggcctgagagggtgaccggccacactggaactgagaaacggtccagactcctacgggaggcagcagtggggaatattgggcaatgggaggaatcctgacccagcgacgccgcgtgaacgaagacggccttcgggttgtaaagttcttttatgtgggaagaaggaagtgacggtaccacatgaataagccccggctaactacgtgccagcagccgcggtaatacgtagggggcgagcgttgtccggaattactgggcgtaaagggcacgcaggctgtgcttcaagtcagctgtaaaaggatgcggcttaaccgtgttatgcggctgagactgaggtgctggagtaccggagaggcaagtggaattcccagtgtagcggtgaaatgcgtagatattgggaagaacatcggtggcgaaggcgacttgctggacggtaactgacgctgaggtgcgaaagccagggtagcgaacgggattagataccccggtagtcctggccgtaaacgatgaatgctaggtgtgcgagcagagatgttggtgtgccgcagttaacgcgataagcattccgcctggggagtacggtcgcaagattgaaactcaaaggaattgacgggggcccgcacaagcggtggagcatgtggtttaattcgatggtacgcgaggaaccttacctgggtttgacatagtatctgatgccgtagagatacggcagcgtagcaatacgaggtacaacgggtgctgcatggctgtcgtcagctcgtgtcgtgagatgttaggttaagtcctgcaacgagcgcaaccctcgtcgtatattgccagcggttcggccgggcactctggcaggactgccatcgacaagattggaggaaggtggggatgacgtcagtcatcatggcccatatgtccagggcgacacacgtgctacaatgggcggtacagagggaagcgacactgcgaggtgaagcggatcccattaaagccgctctcagttcggattgaagtctgcaattcgacttcatgaagttggaatcgctagtaatcgcagatcagccaagctgcggtgaatccgttcccgggccttg

SEQ ID NO: 1911 - DNA, 1535 bp, Syntrophococcus sucromutans
agagtttgatcatggctcaggatgaacgctggcggcgtgcttaacacatgcaagtcgagcgaagcacttttgatttcttcggattgaaggagtgactgagcggcggacgggtgagtaacgcgtggggaacctgccccataccgggggataacagttggaaacgactgctaataccgcataagcgcacaggaaggcatcttccagtgtgaaaaactccggtggtatgggatggacccgcgttggattagccagttggtggggtaacggcctaccaaagcgacgatccatagccggcctgagagggcgaccggccacattgggactgagacacggcccaaactcctacgggaggcagcagtggggaatattgcacaatgggggaaaccctgatgcagcgacgccgcgtgagtgatgaagtatttcggtatgtaaagctctatcagcagggaagaagacgacggtacctgactaagaagccccggctaactacgtgccagcagccgcggtaatacgtagggggcaagcgttatccggatttactgggtgtaaagggagcgcagacggcagtgcaagtctgaagtgaaaacccgaggctcaaccacgggattgctttggaaactgtacagctagagtgtcggaggggtaagcggaattcctagtgtagcggtgaaatgcgtagatattaggaggaacaccggtggcgaaggcggcttactggacgataactgacgttgaggctcgaaagcgtggggagcaaacaggattagataccctggtagtccacgcggtaaacgatgaatactaggtgttggcacgcaaggcgtgtcggtgccgccgcaaacgcattaagtattccacctggggagtacgttcgcaagaatgaaactcaaaggaattgacggggacccgcacaagcggtggagcatgtggtttaattcgaagcaacgcgaagaaccttaccaagtcttgacatccgcctgaccggccggtaacgcggcccttccttcgggacaggcgagacaggtggtgcatggttgtcgtcagctcgtgtcgtgagatgttgggttaagtcccgcaacgagcgcaacccttatcctcagtagccagcacgaaaggtgggcactctggggagactgccagggagaacctggaggaaggtggggatgacgtcaaatcatcatgccccttatgatttgggctacacacgtgctacaatggcgtgaacagagggaagcgaaggggcgatccggagcaaatctcaaaaaacacgtcccagttcggactgcaggctgcaacccgcctgcacgaagctggaatcgctagtaatcgcagatcagaatgctgcggtgaatatgttcccgggtcttgtacacaccgcccgtcacaccatgggagtcggtaatgcccgaagcctgtgacccaaccagcaatggagggagcagtcgaaggcagggccggtgactggggtgaagtcgtaacaaggtagccgtatcggaaggtgcggctggatcacctccttaagcttggtacccggg

SEQ ID NO: 1912 - DNA, 1295 bp, Syntrophomonadaceae sp.
  P1
acgaacgctggcggcgtgcttaacacatgcaagtcgaacgagtggcgaacgggtgagtaacgcatgagtaatctgcccataagcgggggataccaaatggaaacatttgctaataccgcatacggaaagccacttatggatgagctcgcgtctgattagctggttggcagggtaaaggcctaccaaggcaacgatcagtagccggcctgagagggtgaccggccacactgggactgagacacggcccagactcctacgggaggcagcagtggggaatattgcgcaatgggggaaaccctgacgcagcgacgccgcgtgagcgaagaaggccttagggttgtaaagctctgttttaagggacgaagacggtaccttaagaggaagccccggctaactacgtgccagcagccgcggtaagacgtagggggcgagcgttgtccggaatcactgggtgtaaagggcacgcaggcgggtgtttaagtcattcgtgaaataccgcagcttaactgcggggttgcgagtgaaactggaaatcttgagggcaagagaggacagtagaattcctggtgtagcggtgaaatgcgtagaaatcaggaggaataccggtggcgaaggcgactgtctggattgcctgacgctgaggtgcgaaagcgtgggtagcaaacaggattagataccctggtagtctacgctgtaaacgatggatactaggtgtaggagcttctgtgccggagcaaacgcaataagtatcccacctggggagtacgatcgcaaggttgaaactcaaaggaattgacgggggcccgcacaagcggtgagcatgtggtttaattcgatgcaacgcgaagaaccttaccaggtcttaacatcgacaggtggtgcatggttgtcgtcagctcgtgtcgtgagatgttgggttaagtcccgcaacgagcgcaacccctgccattagttactaacaattgaggactctaatgggaccgcctgtgacaagcaggaggaaggtggggatgacgtcaaatcatcatgccctttatgatctgggctacacacgtgctacaatggatggcaaagagcagcaaagcagcgatgccgagccaatctcatccattcccagttcggatggagtctgcaactcgacttcagaagcaggaatcgctagtaatcgtggatcagcatgccacggtgaatgcgttcccgggccttgtacacaccgcccgtcacaccacgaaagtcggcaacacccgaagccggtagctaggcagccgttgaaggtggggttggtgattggggtg

SEQ ID NO: 1913 - DNA, 1451 bp, Tannerella forsythia
agcgataggcttaacacatgcaagtcgaggggcatcgagggtagcaatacctgtcggcgaccggcgcacgggtgagtaacgcgtatgtaacctgcccgcaacagagggataacccggcgaaagtcggactaatacctcataaaacaggggttccgcatggggctatttgttaaagatttattggttgcggatgggcatgcgtaccattaggtagttggtgaggtaacggctcaccaagccatcgatggttaggggttctgagaggaaggtcccccacactggtactgagacacggaccagactcctacgggaggcagcagtgaggaatattggtcaatgggcgagagcctgaaccagccaagtcgcgtgaaggatgactgccctatgggttgtaaacttcttttacaggggaataaaatgagatacgtgtattttattgcatgtaccttgtgaataagcatcggctaactccgtgccagcagccgcggtaatacggaggatgcgagcgttatccggatttattgggtttaaagggtgcgtaggtgggctgttaagtccgcggtgaaagtttgtcgcttaacgataaaattgccgttgaaactggtagtcttgagtatagatgaagtaggcggaatgcgtggtgtagcggtgaaatgcatagagatcacgcagaactccgattgcgaaggcagcttactaaggtataactgacactgaagcacgaaagcgtgggtatcaaacaggattagataccctggtagtccacgcagtaaacgatgattactaggagtttgcgatatagtgtaagctctacagcgaaagcgttaagtaatccacctggggagtacgccggcaacggtgaaactcaaaggaattgacgggggcccgcacaagcggaggaacatgtggtttaattcgatgatacgcgaggaaccttacccgggattgaaatgtagacgacggagagtgagagctttcttcccttcggggcgtctatgtaggtgctgcatggttgtcgtcagctcgtgccgtgaggtgtcggcttaagtgccataacgagcgcaaccctgactgtcagttgctaacaggtaaagctgaggactctggcgggactgccggcgtaagctgtgaggaaggttgggatgacgtcaaatcagcacggcccttacatccggggcgacacacgtgttacaatggcagggacaaagggcagctaccgggcgaccggatgccaatctccaaaccctgtctcagttcggatcggagtctgcaactcgactccgtgaagctggattcgctagtaatcgcgcatcagccatggcgcggtgaatacgttcccgggccttgtacacaccgcccgtcaagccatgggagccgggggtacctgaagtccgtaaccgcgaggatcggcctagggtaaaactggtgactggggctaagtcgtaacaagg

SEQ ID NO: 1914 - DNA, 1375 bp, Tannerella sp.
  6_1_58FAA_CT1
caacatggtatcagcttgctgatactgatggcgaccggcgcacgggtgagtaacgcgtatgtaatctacctgtaacagagggataacccggagaaatccggactaatacctcatagcacatattattcgcatgaattttatgttaaagagactcggttacagatgaacatgcgttccattagctagttggcggggttacggcccaccaaggcaacgatggataggggttctgagaggaaggtcccccacactggtactgagacacggaccagactcctacgggaggcagcagtgaggaatattggtcaatgggcgaaagcctgaaccagccaagtcgcgtggaggaagacggccctacgggttgtaaactccttttacctgggaataacgggcgctacgtgtagcgctgtgcaagtaccgggagaataagcatcggctaattccgtgccagcagccgcggtaatacggaagatgcgagcgttatccggatttattgggtttaaagggtgcgtaggcggaagaataagtcagcggtgaaatgcttcagctcaactggagaattgccgatgaaactgtttttctagagtataaaagaggtatgcggaatgcgtggtgtagcggtgaaatgcatagatatcacgcagaaccccgattgcgaaggcagcatactgggctataactgacgctgaagcacgaaagcgtgggtatcgaacaggattagataccctggtagtccacgccgtaaacgatgaatactaactgtttgcgatataatgtaagcggtacagcgaaagcgttaagtattccacctggggagtacgccggcaacggtgaaactcaaaggaattgacgggggcccgcacaagcggaggaacatgtggtttaattcgatgatacgcgaggaaccttacccgggctcaaacgacaggggaataatcccgaaaaggattagccagcaatgggcgctgtcgaggtgctgcatggttgtcgtcagctcgtgccgtgaggtgtcggcttaagtgccataacgagcgcaacccttaccggtagttactaacaggtcaagctgaggactctaccgggactgccagcgcaagctgcgaggaaggtggggatgacgtcaaatcagcacggcccttacgtccggggcgacacacgtgttacaatggcaggtacagagagtcgcttcgtagcaatacgtagccaatcccaaaaacctgtctcagttcggatcggagtctgcaactcgactccgtgaagctggattcgctagtaatcgcgcatcagccatggcgcggtgaatacgttcccgggccttgtacacaccgcccgtcaagccatgggagccgggagtacctgaagtatgcaaccgcaa

SEQ ID NO: 1915 - DNA, 1474 bp, Tatlockia micdadei
  modified_base (5)..(5): a, c, t, g, unknown or other
  modified_base (5)..(5): a, c, t, g, unknown or other
  modified_base (12)..(14): a, c, t, g, unknown or other
  modified_base (12)..(14): a, c, t, g, unknown or other
  modified_base (29)..(30): a, c, t, g, unknown or other
  modified_base (29)..(30): a, c, t, g, unknown or other
  modified_base (37)..(37): a, c, t, g, unknown or other
  modified_base (37)..(37): a, c, t, g, unknown or other
  modified_base (48)..(48): a, c, t, g, unknown or other
  modified_base (48)..(48): a, c, t, g, unknown or other
  modified_base (80)..(80): a, c, t, g, unknown or other
  modified_base (80)..(80): a, c, t, g, unknown or other
  modified_base (82)..(88): a, c, t, g, unknown or other
  modified_base (82)..(88): a, c, t, g, unknown or other
  modified_base (117)..(117): a, c, t, g, unknown or other
  modified_base (117)..(117): a, c, t, g, unknown or other
  modified_base (130)..(130): a, c, t, g, unknown or other
  modified_base (130)..(130): a, c, t, g, unknown or other
  modified_base (136)..(137): a, c, t, g, unknown or other
  modified_base (136)..(137): a, c, t, g, unknown or other
  modified_base (163)..(163): a, c, t, g, unknown or other
  modified_base (163)..(163): a, c, t, g, unknown or other
  modified_base (169)..(169): a, c, t, g, unknown or other
  modified_base (169)..(169): a, c, t, g, unknown or other
  modified_base (176)..(176): a, c, t, g, unknown or other
  modified_base (176)..(176): a, c, t, g, unknown or other
  modified_base (179)..(179): a, c, t, g, unknown or other
  modified_base (179)..(179): a, c, t, g, unknown or other
  modified_base (222)..(224): a, c, t, g, unknown or other
  modified_base (222)..(224): a, c, t, g, unknown or other
  modified_base (229)..(229): a, c, t, g, unknown or other
  modified_base (229)..(229): a, c, t, g, unknown or other
  modified_base (249)..(249): a, c, t, g, unknown or other
  modified_base (249)..(249): a, c, t, g, unknown or other
  modified_base (304)..(304): a, c, t, g, unknown or other
  modified_base (304)..(304): a, c, t, g, unknown or other
  modified_base (335)..(335): a, c, t, g, unknown or other
  modified_base (335)..(335): a, c, t, g, unknown or other
  modified_base (420)..(420): a, c, t, g, unknown or other
  modified_base (420)..(420): a, c, t, g, unknown or other
  modified_base (426)..(426): a, c, t, g, unknown or other
  modified_base (426)..(426): a, c, t, g, unknown or other
  modified_base (452)..(452): a, c, t, g, unknown or other
  modified_base (452)..(452): a, c, t, g, unknown or other
  modified_base (479)..(479): a, c, t, g, unknown or other
  modified_base (479)..(479): a, c, t, g, unknown or other
  modified_base (508)..(508): a, c, t, g, unknown or other
  modified_base (508)..(508): a, c, t, g, unknown or other
  modified_base (552)..(552): a, c, t, g, unknown or other
  modified_base (552)..(552): a, c, t, g, unknown or other
  modified_base (571)..(571): a, c, t, g, unknown or other
  modified_base (571)..(571): a, c, t, g, unknown or other
  modified_base (589)..(591): a, c, t, g, unknown or other
  modified_base (589)..(591): a, c, t, g, unknown or other
  modified_base (598)..(598): a, c, t, g, unknown or other
  modified_base (598)..(598): a, c, t, g, unknown or other
  modified_base (625)..(625): a, c, t, g, unknown or other
  modified_base (625)..(625): a, c, t, g, unknown or other
  modified_base (652)..(653): a, c, t, g, unknown or other
  modified_base (652)..(653): a, c, t, g, unknown or other
  modified_base (828)..(828): a, c, t, g, unknown or other
  modified_base (828)..(828): a, c, t, g, unknown or other
  modified_base (886)..(886): a, c, t, g, unknown or other
  modified_base (886)..(886): a, c, t, g, unknown or other
  modified_base (945)..(945): a, c, t, g, unknown or other
  modified_base (945)..(945): a, c, t, g, unknown or other
  modified_base (957)..(959): a, c, t, g, unknown or other
  modified_base (957)..(959): a, c, t, g, unknown or other
  modified_base (983)..(983): a, c, t, g, unknown or other
  modified_base (983)..(983): a, c, t, g, unknown or other
  modified_base (993)..(993): a, c, t, g, unknown or other
  modified_base (993)..(993): a, c, t, g, unknown or other
  modified_base (1042)..(1042): a, c, t, g, unknown or other
  modified_base (1042)..(1042): a, c, t, g, unknown or other
  modified_base (1092)..(1092): a, c, t, g, unknown or other
  modified_base (1092)..(1092): a, c, t, g, unknown or other
  modified_base (1117)..(1117): a, c, t, g, unknown or other
  modified_base (1117)..(1117): a, c, t, g, unknown or other
  modified_base (1213)..(1213): a, c, t, g, unknown or other
  modified_base (1213)..(1213): a, c, t, g, unknown or other
  modified_base (1276)..(1276): a, c, t, g, unknown or other
  modified_base (1276)..(1276): a, c, t, g, unknown or other
  modified_base (1287)..(1287): a, c, t, g, unknown or other
  modified_base (1287)..(1287): a, c, t, g, unknown or other
  modified_base (1296)..(1296): a, c, t, g, unknown or other
  modified_base (1296)..(1296): a, c, t, g, unknown or other
  modified_base (1302)..(1302): a, c, t, g, unknown or other
  modified_base (1302)..(1302): a, c, t, g, unknown or other
aactnaagagtnnnatcctggctcagatnnaacgctngcggcatgctnaacacatgcaagtcgaacggcagcacggtctngnnnnnnnatgggtgacgagtggcgaacgggtgagtnacgcgtaggaatntgcctnnaagtgtgggataacttggggaaactnaagctnataccgnatnagctctaaggaggaaagctggggaccgcgaggcctgcgcgctnnnagatnagcctgcgtccgattagctngttggtgggggaagggcctaccaaggcgacgatcggtagctggtctgagaggatnatcagccacactgggactgagacacggcccngtctcctacgggaggcagcagtggggaatattggacaatggggggaaccctratccagcaatgccgcgtgtgtgaagaaggcctnagggtngtaaagcactttcagtggggaggagngrtgataggttaagagctaattatctngacgttacccacagaagaagcaccggctnactccgtgccagcagccgcggtaatacggagggtgcgagcgttnatcggaattactgggcgtnaagggtgcgtaggtggtnnnataagtnatctgtgaaattcctgggctcaacctngggtggtcagataagactgtgagactnngagtataggagagggtagtggaatttccggtgtagcggtgaaatgcgtagagatcggaaggaacaccagtggcgaaggcggctacctggcctaatactgacactgaggcacgaaagcgtggggagcaaacaggattagataccctggtagtccacgctgtaaacgatgtcaactngttgttggccttatgaatgaggttagtgacgaagcaaacgcgataagttgaccgcctngggagtacggtcgcaagatyaaaactcaaaggaattgacgggggcccgcacaagcggtngagcatgtggtnnnattcgatgcaacgcgaagaacctnacctaccctngacatacagtgaattctgcagagatgtggaagtgccgcgaggagcactnatacaggtgctgcatggctgtcgtcagctcgtgtcgtgagatgttgggtnaagtcccgtaacgagcgcaaccctngtycttagttgccagcgcgtagatggyggggactctaaggagactgccggtgacaaaccggaggaaggcggggatgacgtcaagtcatcatggccnttacgggtagggctacacacgtgctacaatggccggtacagagggcggcgaaggggagacctngagcaaatctntgaaagctngtcgtngtccggattgaagtctgcaactcgactkcatgaagtcggaatcgctagtaatcgcgaatcagcatgtcgcggtgaatacgttcccgggccttgtacacaccgcccgtcacaccatgggagtgggttgcaccagaagtagatagtctaaccaatgggggacgtataccacggt

SEQ ID NO: 1916 - DNA, 1480 bp, Tatumella ptyseos
ggcggcaggcctaacacatgcaagtcgaacggtagcacagaggagcttgctccttgggtgacgagtggcggacgggtgagtaatgtctgggaaactgcctgatggagggggataactactggaaacggtagctaataccgcataatgtcgcaagaccaaagcgggggaccttcgggcctcgcaccatcggatgtgcccagatgggattagcttgtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcagtcgtgttaatagcacgattgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacccgggaactgcattcgaaactggcagactagagtcttctagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggctgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttgccagagatggattggtgccttcgggaactctgagacaggtgctgcatggctgtcgtcagctcgtgttgtgaaatgttgggttaagtcccgcaacgagcgcaacccctatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtagatagcttaaccttcgggagggcgtttaccactttgtgattcatgactggggtgaagtcgtaacaaggtaaccgtagggg

SEQ ID NO: 1917 - DNA, 1479 bp, Tessaracoccus sp.
  oral taxon F04
agagtttgatcctggctcaggacgaacgctggcggcgtgcttaacacatgcaagtcgaacggtaaggccctttcgggggtacacgagtggcgaacgggtgagtaacacgtgagtaacctgcccttgactctgggataacatctggaaacaggtgctaatactggatattctgcgatgcctgcatgggtgtcgttggaaagttccggcggtcagggatggactcgcggcctatcagcttgttggtgaggtagtggctcaccaaggcttcgacgggtagccggactgagaggttgaccggccacattgggactgagatacggcccaaactcctacgggaggcagcagtggggaatattgcacaatggacggaagtctgatgcagcaacgccgcgtgcgggatgacggccttcgggttgtaaaccgctttcatccatgacgaagcgagagtgacggtagtgggagaagaagcaccggctaactacgtgccagcagccgcggtgatacgtagggtgcgagcgttgtccggatttattgggcgtaaagagcttgtaggcggtttgttgcgtcgggagtgaaaactcagggcttaaccctgagcctgctttcgatacgggcagacttgaggaaggtaggggagaatggaattcctggtgaagcggtggaatgcgtagatatcaggaggaacaccagtggcgaaggcggttctctggacctttcctgatgctgagaagcgaaagcgtggggagcaaacaggcttagataccctggtagtccacgccgtaaacggtgggtactaggtgtgggggacattccacgttctccgtgccgcagctaacgcattaagtaccccgcctggggagtacggccgcaaggctaaaactcaaaggaattgacggggccccgcacaagcggcggagcatgcggattaattcgatgcaacgcggagaaccttacctgggtttgacatatgccggaaacatctagagataggtgcccctttttggtcggtataccggtggtgcatggctgtcgtcagctcgtgtcgtgagatgttgggttaagtcccgcaacgagcgcaaccctcgtcctatgttgccagcgggtaatgccggggactcataggagaccgccggggtcaactcggaggaaggtggggatgacgtcaagtcatcatgccccttatgtccagggcttcacgcatgctacaatggccggtacaaagagctgcgaacctgtgagggtgagcgaatctcaaaaagccggtctcagttcggattggggtctgcaactcgaccccatgaagtcggagtcgctagtaatcgcagatcagcaacgctgcggtgaatacgttcccggggcttgtacacaccgcccgtcaagtcatgaaagtcggtaacacccgaagccggtggcctaaccccttgtgggagggagctgtcgaaggtgggaccggtaattaggactaagtcgtaacaaggt

SEQ ID NO: 1918 - DNA, 1562 bp, Tetragenococcus halophilus
tcaagatgagagtttgatcctggctcaggacgaacgctggcggcgtgcctaatacatgcaagtcgaacgctgcttaagaagaaacttcggttttttcttaagtggagtggcggacgggtgagtaacacgtggggaacctatccatcagcgggggataacacttggaaacaggtgctaataccgcatacggctttttttcacctgaaagaaagctcaaaggcgctttacagcgtcactgatggctggtcccgcggtgcattagccagttggtgaggtaacggctcaccaaagcaacgatgcatagccgacctgagagggtgatcggccacactgggactgagacacggcccagactcctacgggaggcagcagtagggaatcttcggcaatggacgcaagtctgaccgagcaacgccgcgtgagtgaagaaggttttcggatcgtaaagctctgttgtcagcaaagaacaggagaaagaggaaatgctttttccatgacggtagctgaccagaaagccacggctaactacgtgccagcagccgcggtaatacgtaggtggcaagcgttgtccggatttattgggcgtaaagcgagcgcaggcggtgatttaagtctgatgtgaaagcccccagctcaactggggagggtcattggaaactggatcacttgagtgcagaagaggagagtggaattccatgtgtagcggtgaaatgcgtagatatatggaggaacaccagtggcgaaggcggctctctggtctgtaactgacgctgaggctcgaaagcgtgggtagcaaacaggattagataccctggtagtccacgccgtaaacgatgagtgctaagtgttggagggtttccgcccttcagtgctgcagttaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccgccctagagatagggtttccccttcgggggcaaagtgacaggtggtgcatggttgtcgtcagctcgtgtcgtgagatgttgggttaagtcccgtaacgagcgcaacccttattgttagttgccagcattgagttgggcactctagcaagactgccggtgacaaaccggaggaaggcggggatgacgtcaaatcatcatgccccttatgacctgggctacacacgtgctacaatgggaagtacaacgagcaagccaagccgcaaggcctagcgaatctctgaaagcttctctcagttcggattgcaggctgcaactcgcctgcatgaagccggaatcgctagtaatcgcggatcagcatgccgcggtgaatccgttcccgggccttgtacacaccgcccgtcacaccacgagagtttgtaacacccaaagtcggtgcggcaacccttaggggagccagccgcctaaggtgggacgaatgattggggtgaagtcgtaacaaggtagccgtatcggaaggtgcggctggatcacctcctttct

SEQ ID NO: 1919 - DNA, 1492 bp, Tetragenococcus koreensis
ctcaggacgaacgctggcggcgtgcctaatacatgcaagtcgaacgctgcttcgatcgaaacttcggtttcttttgaagcggagtggcggacgggtgagtaacacgtggggaacctatccatcagcgggggataacacttggaaacaggtgctaataccgcataaggctttctttcgcctgaaagaaagctaaaaggcgctttttgcgtcactgatggctggtcccgcggtgcattagccagttggtgaggtaacggctcaccaaagcaacgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaagctctgttgtcagtaaagaacaggaaaaagaggcaatgctttttctatgacggtagctgaccagaaagccacggctaactacgtgccagcagccgcggtaatacgtaggtggcaagcgttgtccggatttattgggcgtaaagcgagcgcaggcggtgatttaagtctgatgtgaaagcccccggctcaaccggggagggtcattggaaactggatcacttgagtgcagaagaggagagtggaattccatgtgtagcggtgaaatgcgtagatatatggaggaacaccagtggcgaaggcggctctctggtctgtaactgacgctgaggctcgaaagcgtgggtagcaaacaggattagataccctggtagtccacgccgtaaacgatgagtgctaagtgttggagggtttccgcccttcagtgctgcagttaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccacgcgagagatcgcgtttccccttcgggggcaaagtgacaggtggtgcatggttgtcgtcagctcgtgtcgtgagatgttgggttaagtcccgcaacgagcgcaacccttattgttagttgccagcattcagttgggcactctagcaagactgccggtgacaaaccggaggaaggtggggatgacgtcaaatcatcatgccccttatgacctgggctacacacgtgctacaatgggaagtacaacgagcaagccaagccgcaaggccgcgcgaatctctgaaagcttctctcagttcggattgcaggctgcaactcgcctgcatgaagccggaatcgctagtaatcgcggatcagcatgccgcggtgaatccgttcccgggccttgtacacaccgcccgtcacaccacgagagtttgtaacacccaaagtccggtgcggcaacctcattagaggagccagccgcctaaggtgggatgaatgattggggtgaagt

SEQ ID NO: 1920 - DNA, 1454 bp, Thermoanaerobacter pseudethanolicus
agttgagtgccggatagcggcggacgggtgagtaacgcgtgggcaacctacccttaagaccgggataacacctcgaaaggggtgctaatactggataagctccttgtagggcatcctatgaggagggaaggtagcgggagctaccgcttaaggatgggcccgcgtcccatcagctagttggtagggtaacggcctaccaaggcgacgacgggtagccggcctgagagggtggtcggccacactgggactgagacacggcccagactcctacgggaggcagcagtggggaatcttgcgcaatgggcgaaagcctgacgcagcgacgccgcgtgagcgaggaaggccttcgggtcgtaaagctcgatagtgtgggaagaagggatgacggtaccacacgaaagccccggctaactacgtgccagcagccgcggtaagacgtagggggcgagcgttgtccggaattactgggcgtaaagggcgcgtaggcggccgttcaagtcaggtgtaaaatacccgggctcaacccggggatagcacttgaaactgggcggctagagggcaggagaggggagtggaattcccggtgtagcggtgaaatgcgtagatatcgggaggaataccagtggcgaaggcgactctctggactgaccctgacgctgaggcgcgaaagcgtggggagcaaacaggattagataccctggtagtccacgccgtaaacgatgggtactaggtgtgggatgcggaagcattccgtgccgtagttaacgcaataagtaccccgcctggggagtacggccgcaaggttgaaactcaaaggaattgacgggggcccgcacaagcggtggagcatgtggtttaattcgaagcaacgcgaagaaccttaccagggcttgacatgcaggtagtagcgagccgaaaggtgagcgaccttaccttaaaggtgaggagcctgcacaggtggtgcatggttgtcgtcagctcgtgtcgtgagatgttgggttaagtcccgcaacgagcgcaacccctgcctctagttgccagcgggtgaagccgggcactctagagggactgccgtggacaacacggaggaaggtggggatgacgtcaaatcatcatgccctatatgccctgggccacacacgtgctacaatggccggtacagagggaagcgaagccgcgaggtggagcgaaacccaaaaagccggtccaagttcggattgcaggctgcaactcgcctgcatgaagtcggaatcgctagtaatcgcggatcagcatgccgcggtgaatacgttcccgggccttgtacacaccgcccgtcacaccacgagagtctgcaacacccgaagccggtgacccaaccgggaaggagggagccgtcgaaggtggggcagatgattggggtgaagtcgtaacaaggtagccgtatcggaaggtgcggctggatcacctccttt

SEQ ID NO: 1921 - DNA, 1542 bp, Thermobifida fusca
ggagagtttgatcctggctcaggacgaacgctggcggcgtgcttaacacatgcaagtcgagcggtaaggccccttcgggggtacacgagcggcgaacgggtgagtaacacgtgagtaacctgcccctgactctgggataagcctgggaaactgggtctaataccggatatgacctcgtgccgcatggtgtggggtggaaaggtgtttttccggtcagggatgggctcgcggcctatcagcttgttggtggggtaacggcctaccaaggcgatgacgggtagccggcctgagagggcgaccggccacactgggactgagacacggcccagactcctgcgggaggcagcagtggggaatattgcgcaatgggcggaagcctgacgcagcgacgccgcgtgggggatgaaggccttcgggttgtaaacctcttttaccactcacgaaggcccctggttttctgggggttgacggtaggtggtgaataaggaccggctaactacgtgccagcagccgcggtaatacgtagggtccgagcgttgtccggaattattgggcgtaaagagctcgtaggcggcctgtcgcgtctgctgtgaaagtccggggcttaactccgggtgtgcagtggatacgggcaggcttgaggtaggtaggggagactggaattcctggtgtagcggtgaaatgcgcagatatcaggaggaacaccggtggcgaaggcgggtctctgggccttacctgacgctgaggagcgaaagcgtggggagcgaacaggattagataccctggtagtccacgccgtaaacgttgggcgctaggtgtggggactttccacggtttccgtgccgtagctaacgcattaagcgccccgcctggggagtacggccgcaaggctaaaactcaaaggaattgacgggggcccgcacaagcggcggagcatgttgcttaattcgacgcaacgcgaagaaccttaccaaggcttgacatcaccggtaatcctccagagatggggggtccttcggggatcggtgacaggtggtgcatggctgtcgtcagctcgtgtcgtgagatgttgggttaagtcccgcaacgagcgcaacccctgtcccatgttgccagcacgtggtggtggggactcatgggagactgccggggtcaactcggaggaaggtggggatgacgtcaagtcatcatgccccttatgccttgggctgcaaacatgctacaatggccggtacagagggcgtgcgatgtcgtgaggcggagcgaatctcttaaagccggtctcagttcggattggggtctgcaactcgaccccatgaaggtggagtcgctagtaatcgcggatcagcaacgccgcggtgaatacgttcccgggccttgtacacaccgcccgtcacgtcacgaaagtcggcaacacccgaaacacgtggcctaaccctttgtgggggggagcgtgtgaaggtggggctggcgattgggacgaagtcgtaacaaggtagccgtaccggaaggtgcggctggatcacctcctttctaaggagc

SEQ ID NO: 1922 - DNA, 1503 bp, Thermofilum pendens
actccggttgatcctgccggacccgaccgctatcggggtggggctaacccatggaagtctaggagccggggctacggccggctccggcggacggctcagtagcacgtggctaacctaccctcgggagggggataaccccgggaaactggggataaacccccataggcgcggacacctggaatgggtccgcgctgaaagggccacggtaccatgcttaccgtggccgcccgaggatggggctgcgccctatcaggtagttggcggggtaacggcccgccaagccgataacgggtgggggccgtgagagcgggagccccgagatgggcactgagacaagggcccaggccctacggggtgcaccaggggcgaaacttccgcaatgcgggaaaccgtgacggagtcaccccgagtgccacccgaagagggtggcttttgcccggtctaaaaagccgggcgaataagcggggggcaagcttggtgtcagccgccgcggtaataccaaccccgcgagtggtcgggacgtttattgggcctaaagcgtccgtagccggcccggtaagtccctccttaaagcccacggctcaaccgtgggagcggagggatactgccgggctagggggcgggagaggccgggggtactcctggggtaggggcgaaatcctataatcccaggaggaccaccagtggcgaaggcgcccggctagcacgcgcccgacggtgagggacgaaagctgggggagcaaaggggattagatacccccgtagtcccagctgtaaacgatgcgggctaggtgttggacgggcttcgagcccgtccagtgccgtagggaagccgttaagcccgccgcctggggagtacggccgcaaggctgaaacttaaaggaattggcgggggagcaccacaaggggtgaagcttgcggtttaattggagtcaacgccggaaaccttaccgggggcgacagcaggatgaaggccaggctgacgaccttgccagacgagctgagaggaggtgcatggccgtcgccggctcgtgccgtgaggtgtcctgttaagtcagggaacgagcgagacccccgcccctagttgctacccagcccttcggggctggggcactctagggggactgccggcgataagccggaggaaggtgggggctacggcaggtcagtatgccccgaaacccccgggctacacgcgagctgcaatggcggggacagcgggttccgaccccgaaagggggaggtaatcccttaaaccccgcctcagtaggaatcgagggctgcaactcgccctcgtgaacgtggaatccctagtaaccgcgtgtcaccaacgcgcggtgaatacgtccctgctccttgcacacaccgcccgtcgctccacccgagggaggcctaggtgaggcctcctgccgacgaggtgggaggtcgaacctgggcctcccaaggggggagaagtcgtaacaaggtggccgtaggggaacctgcggccggatcacctccttt

SEQ ID NO: 1923 - DNA, 1470 bp, Thermus aquaticus
gctcagggtgaacgctggcggcgtgcctaagacatgcaagtcgtgcgggccgtggggtatctcacggtcagcggcggacgggtgagtaacgcgtgggtgacctacccggaagagggggacaacatggggaaacccaggctaatcccccatgtggacacatcctgtggggtgtgtttaaagggttttgcccgcttccggatgggcccgcgtcccatcagctagttggtggggtaagagcccaccaaggcgacgacgggtagccggtctgagaggacggccggccacaggggcactgagacacgggccccactcctacgggaggcagcagttaggaatcttccgcaatgggcgcaagcctgacggagcgacgccgcttggaggaggaagcccttcggggtgtaaactcctgaacccgggacgaaacccccgatgaggggactgacggtaccggggtaatagcgccggccaactccgtgccagcagccgcggtaatacggagggcgcgagcgttacccggatttactgggcgtaaagggcgtgtaggcggcttggggcgtcccatgtgaaaggccacggctcaaccgtggaggagcgtgggatacgctcaggctagacggtgggagagggtggtggaattcccggagtagcggtgaaatgcgcagataccgggaggaacgccgatggcgaaggcagccacctggtccactcgtgacgctgaggcgcgaaagcgtggggagcaaaccggattagatacccgggtagtccacgccctaaacgatgcgcgctaggtctctgggttatctgggggccgaagctaacgcgttaagcgcgccgcctggggagtacggccgcaaggctgaaactcaaaggaattgacgggggcccgcacaagcggtggagcatgtggtttaattcgaagcaacgcgaagaaccttaccaggccttgacatgctagggaacctgggtgaaagcctggggtgccccgcgaggggagccctagcacaggtgctgcatggccgtcgtcagctcgtgtcgtgagatgttgggttaagtcccgcaacgagcgcaacccctgccgttagttgccagcgggtgaagccgggcactctaacgggactgcctgcgaaagcaggaggaaggcggggacgacgtctggtcatcatggcccttacggcctgggcgacacacgtgctacaatgcccactacagagcgaggcgacctggcaacagggagcgaatcgcaaaaaggtgggcgtagttcggattggggtctgcaacccgaccccatgaagccggaatcgctagtaatcgcggatcagccatgccgcggtgaatacgttcccgggccttgtacacaccgcccgtcacgccatgggagcgggttctacccgaagtcgccgggagccttagggcaggcgccgagggtagggcccgtgactggggcgaagtcgtaacaaggtagctgtaccg

SEQ ID NO: 1924 - DNA, 1400 bp, Tissierella praeacuta
ggctcaggacgaacgctggcggcgtgcctaacacatgcaagtcgagcgaagtttttaaagaagatttcttcggaatgaaactttaattatcttagcggcggacgggtgagtaacgcgtgagaaacctgccttttacaaagggatagcctcgggaaactgggattaataccttatgacactgtcgcatgagatttaagtcaaagcgtaaagcggtaaaagatggtctcgcgtcccattagttagttggtgaggtaaaggctcaccaagacagcgatgggtagccggcctgagagggtgaacggccacactggaactgagacacggtccagactcctacgggaggcagcagtggggaatattgcacaatggaggaaactctgatgcagcgacgccgcgtgaacgatgaaggctttcgggtcgtaaagttctgtcctaagggacgataatgacggtaccttaggaggaagccccggctaactacgtgccagcagccgcggtaatacgtagggggcaagcgttgtccggatttattgggcgtaaagggtgcgtaggcggccttttaagtcagatgtgaaagatcacggctcaaccgtggtaagcatttgaaactgaaaggcttgagttaaggagaggaaagtggaattcctagtgtagcggtgaaatgcgtagatattaggaggaataccagtggcgaaggcgactttctggacttatactgacgctgaggcacgaaagcgtggggagcgaacaggattagataccctggtagtccacgccgtaaacgatgagtgctaggtgttgggggtcaaacctcggtgccgcagctaacgcattaagcactccgcctggggagtacgtacgcaagtatgaaactcaaaggaattgacggggacccgcacaagcagcggagcatgtggtttaattcgaagcaacgcgaagaaccttaccagggcttgacatgcccctgaccgtcctagagatagggctttaccttcgggtacaggggacacaggtggtgcatggttgtcgtcagctcgtgtcgtgagatgttgggttaagtcccgcaacgagcgcaacccttgcctttagttgctaacagataagctgagcactctagagggactgccgatgacaaatcggaggaaggtggggatgacgtcaaatcatcatgccctttatgtcctgggctacacacgtgctacaatggtcggtacaacgagcagctacttagcgataagatgctaatctcttaaagccgatcccagttcggattgcaggctgcaactcgcctgcatgaagtcggagttgctagtaatcgcggatcagaatgtcgcggtgaatgcgttcccgggtcttgtacacaccgcccgtcacaccatgggagttggcaatacccgaag

SEQ ID NO: 1925 - DNA, 1441 bp, Trabulsiella guamensis
acgctggcgcagccttacacatgcaagtcgagcggcagcgggggaaagctgctttcccgccggcgagcggcggacgggtgagtaatgtctgggaaactgcctgatggagggggataactactggaaacggtagctaataccgcataacgtcttcggaccaaagtgggggaccttcgggcctcatgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccagagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtgttttaatttcgatgcaacgcgaagaaccttacctggtcttgacacccacagaaccctgtagagatacgggggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatgcatatacaagagaagcgacctcgcgagagcaagcggcctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccacttgtgatta

SEQ ID NO: 1926 - DNA, 1543 bp, Treponema denticola
tggagagtttgatcctggctcagaacgaacgctggcggcgcgtcttaagcatgcaagtcgaacggtaagggagagcttgctctcccctagagtggcggactggtgagtaacgcgtgggtgacctgccctgaagatggggatagctagtagaaatattagataataccgaatgtgctcatttacataaaggtaaatgaggaaaggagctacggctccgcttcaggatgggcccgcgtcccattagctggttggtgaggtaaaggctcaccaaggcaacgatgggtatccggcctgagagggtgaacggacacattgggactgagatacggcccaaactcctacgggaggcagcagctaagaatcttccgcaatggacgaaagtctgacggagcgacgccgtgtgaatgaagaaggccgaaaggttgtaaaattcttttgcagatgaagaataagaagaagagggaatgcttctttgatgacggtagtcatgcgaataagccccggctaattacgtgccagcagccgcggtaacacgtaaggggcgagcgttgttcggaattattgggcgtaaagggtatgtaggcggttaggtaagcctggtgtgaaatctacgagctcaactcgtaaactgcattgggtactgcttgacttgaatcacggaggggaaaccggaattccaagtgtaggggtggaatctgtagatatttggaagaacaccggtggcgaaggcgggtttctggccgatgattgacgctgatatacgaaggtgcggggagcaaacaggattagataccctggtagtccgcacagtaaacgatgtacactaggtgtcggggcaagagcttcggtgccgacgcaaacgcattaagtgtaccgcctgggaagtatgcccgcaagggtgaaactcaaaggaattgacgggggcccacacaagcggtggagcatgtggtttaattcgatgatacgcgagaaaccttacctgggtttgacatcaagagcaatgacatagagatatggcagcgtagcaatacggctcttgacaggtgctgcatggctgtcgtcagctcgtgccgtgaggtgttgggttaagtcccgcaacgagcgcaacccctactgccagttactaacaggtaaagctgaggactctggcggaactgccgatgacaaatcggaggaaggtggggatgacgtcaagtcatcatggcccttacgtccagggctacacacgtgctacaatggttgctacaaatcgaagcgacaccgcgaggtcaagcaaaacgcaaaaaagcaatcgtagtccggattgaagtctgaaactcgacttcatgaagttggaatcgctagtaatcgcacatcagcacggtgcggtgaatacgttcctgggccttgtacacaccgcccgtcacaccatccgagtcgagggtacccgaagtcgctagtctaacccgtaagggaggacggtgccgaaggtacgtttggtaaggagggtgaagtcgtaacaaggtagccgtaccggaaggtgcggctggatcacctcctttct

SEQ ID NO: 1927 - DNA, 1297 bp, Treponema sp.
  P1
aacgaacgctggcggcgcgtcttaagcatgcaagtcgaacgagtggcggactggtgaggaacacgtgggtaatctacccttaagatggggatagctgttagaaatagcaggtaataccgaatacagaaagtcgcttgaggatgagcttgcgtcccattagctagttggtgaggtaacggcccaccaaggcgacgatgggtatccggcctgagagggtgaacggacacattgggactgagatacggcccaaactcctacgggaggcagcagctaagaatattccgcaatggacggaagtctgacggagcgacgccgcgtggatgaagaaggctgaaaagttgtaaaatccttttgttgatgaagatgacggtagtcggtgaataagccccggctaattacgtgccagcagccgcggtaacacgtaaggggcgagcgttgttcggaattattgggcgtaaagggcatgtaggcggttatgtaagcctgatgtgaaatcctggggcttaaccccagaatagcattgggtactgtgtaactcgaattacggaagggaaactggaattccaagtgtaggggtggaatctgtagatatttggaagaacaccggtggcgaaggcgggtttctggccgaattgacgctgagatgcgaaagtgtggggatcgaacaggattagataccctggtagtccacaccgtaaacgatgtacactaggtgttggggcttcagtgccaaagcaaacgcgataagtgtaccgcctggggagtatgcccgcaagggtgaaactcaaaggaattgacgggggcccgcacaagcggtggagcatgtggtttaattcgatggtacgcgaggaaccttacctgggtttgacatcgacaggtgctgcatggctgtcgtcagctcgtgccgtgaggtgttgggttaagtcccgcaacgagcgcaacccctactgccagttactaacagctgaggactctggcggaactgccgatgacaaatcggaggaaggtggggatgacgtcaagtcatcatggcccttatgtccagggctacacacgtgctacaatggttgccaaagcgacgcgagaccgtaaggtggagcaaaccgcaagcgatcgtagttcggatgaagtctgaaactcgacttcagaagttggaatcgctagtaatcgcgcatcagcacggcgcggtgaatacgttcccgggccttgtacacaccgcccgtcacaccatccgagttgggggtacccgaagtcgctgtctaggacggtgccgaaggtacgcttggtaaggagggtg

SEQ ID NO: 1928 - DNA, 1297 bp, Treponema sp.
  P4 oral clone MB2_G19
aacgaacgctggcggtgcgttttaagcatgcaagtcgaacgagtggcggactggtgagtaacgcgtgggtgatctacctttaagatggggatagcttttagaaataagagataataccgaatatggaaagccgcttgaagatgagcctgcgtcccattagctagttggtggggtaaaggcctaccaaggcaatgatgggtatccggcctgagagggtgaccggacacattgggactgagatacggcccaaactcctacgggaggcagcagctgagaatcttccgcaatggacgaaagtctgacggagcgacaccgcgtgaatgatgaaggccgaaaggttgtaaagttcttttgcagacaaagatgacggtagtttgcgaataagccccggctaattacgtgccagcagccgcggtaatacgtaaggggcgagcgttgttcggaattattgggcgtaaagggcatgtaggcggtttagtaagcctgatgtgaaatctacgagcttaactcgtaaactgcattgggtactgcttaactagagttatggaggggaaactggaattccaagtgtaggggtggaatctgtagatatttggaagaacaccggtggcgaaggcgggtttctagccaaactgacgctgatatgcgaaggtgcggggagcaaacaggattagataccctggtagtccgcacagtaaactatgtacactagatgttggggactcagtgttgaagcaaacgcaataagtgtaccgcctggggagtatgcccgcaagggtgaaactcaaaggaattgacgggggcccacacaagcggtggagcatgtggtttaattcgatgatacgcgaggaaccttacctgggtttgacatcgacaggtgctgcatggctgtcgtcagctcgtgccgtgaggtgttgggttaagtcccgcaacgagcgcaacccctactgccagttactaacagctgaggactctggcggaactgccggtgataaaccggaggaaggtgggggtgacgtcaagtcatcatggcccttatgtccagggctacacacgtgctacaatggttgtcaaagtgatgcgaagtcgcgagacggagcgaaacgcatgcaatcgtagtccggatggaatctgaaacctgattccagaagctggaatcgctagtaatcgcatatcagcacgatgcggtgaatacgttcctgggccttgtacacaccgcccgtcacaccatccgagtcgagggtacccgaagatgctgtctaggacggtggcgaaggtacgtttggtaaggagggtg

SEQ ID NO: 1929 - DNA, 1297 bp, Treponema sp.
  P5 oral clone MB3_P23
aacgaacgctggcggtgcgtcttaagcatgcaagtcgaacgagtggcggactggtgagtaacgcgtggatgatctacctttgagatggggatagcttctagaaataggaggtaataccgaataacaaaagccgctcgaagatgagtctgcgtcccattagctagttggtgaggtaaaggcccaccaaggcgacgatgggtacccggcctgagagggtgaacgggcacattgggactgagatacggcccaaactcctacgggaggcagcagctgagaatcttccgcaatggacgaaagtctgacggagcgacaccgcgtgaacgatgaaggccggaaggttgtaaagttcttttgcagacaaagatgacggtagtttgcgaataagccccggctaattacgtgccagcagccgcggtaatacgtaaggggcgagcgttgttcggaattattgggcgtaaagggcatgtaggcggttaggtaagcctgatgtgaaatgtatgagcttaactcataaactgcattgggtactgcttgacttgaatcatggaggggaaactggaattccaagtgtaggggtggaatctgtagatatttggaagaacaccggtggcgaaggcgggtttctagccaaattgacgctaaggtgcgagggtgcggggagcaaacaggattagataccctggtagtccgcacagtaaacgatgtacactaggtgttggggactcagtgccggagcaaacgcaataagtgtaccgcctggggagtatgcccgcaagggtgaaactcaaaggaattgacgggggcccacacaagcggtggagcatgtggtttaattcgatgatacgcgaggaaccttacctgggtttgacatcgacaggtgctgcatggctgtcgtcagctcgtgccgtgaggtgttgggttaagtcccgcaacgagcgcaacccctactgccagttactaacagctgaggactcaggcggaactgccggtgatataccggaggaaggtggggatgacgtcaagtcatcatggcccttatgtccagggctacacacgtgctacaatggttgtcaaagtgaggcgaagccgcgaggttaagcgaatcgcaagcaatcgtagtccggatggaatctgaaacctgattccagaagctggaatcgctagtaatcgcatatcagcacgatgcggtgaatacgttcctgggccttgtacacaccgcccgtcacaccatccgagtcgaaggtacccgaagatgctgtctaggacggtggcgaaggtacgtttggtaaggagggtg

SEQ ID NO: 1930 - DNA, 1297 bp, Treponema sp.
  P6 oral clone MB4_G11
aacgaacgctggcggtgcgttttaagcttgcaagtcgaacgagtggcggactggtgagtaacgcgtaggtgatctacctttaagactgggacagcctttagaaataaggggtaataccggatgtgggaagccgcttagagatgagcctgcgtcccattagctagttggtaaggtaacggcctaccaaggcgatgatgggtatccgacctgagagggtgatcggacacattgggactgagatacggcccaaactcctacgggaggcagcagctgagaatcttccgcaatggacgaaagtcggacggagcgacaccgcgtgaatgatgaaggccgaagggttgtaaagttcttttgcagacaaagatgacggtagtttgcgaataagccccggctaattacgtgccagcagccgcggtaatacgtaaggggcgagcgttgctcggaattattgggcgtaaagggcatgtaggcggttgggtaagcctgatgtgaaatctacgagcttaactcgtaaactgcattgggtactgctcatcttgaatcatagagggggaactggaattccaagtgtaggggtggaatctgtagatatttggaagaacaccggtggcgaaggcgggttcctagctaaattgacgctgatgtgcgaaggtgcggggagcaaacaggattagataccctggtagtccgctcagtaaacgatgtacactaggtgttggggactcagtgccggcgcaaacgcaataagtgtaccgcctggggagtatgcccgcaagggtgaaactcaaaggaattgacgggggcccacacaagcggtggagcatgtggtttaattcgatgatacgcgaggaaccttacctgggtttgacatcgacaggtgcagcatggctgtcgtcagctcgtgccgtgaggtgttgggttaagtcccgcaacgagcgcaacccctactgccagttactaacagctgaggactctggcggaactgccggtgataaaccggaggaaggtggggatgacgtcaagtcatcatggcccttatgtccagggctacacacgtgctacaatggttgtcaaagtgatgcgaagtcgcgagacggagcgaaacgcatgcaatcgtagtccggatggaatctgaaacctgattccagaagctggaatcgctagtaatcgcatatcagcacgatgcggtgaatacgttcctgggtcttgtacacaccgcccgtcacaccatccgagtcgagggtacccgaagatgctgtctaggacggtggcgaaggtacgtttggtaaggagggtg

SEQ ID NO: 1931 - DNA, 1479 bp, Treponema lecithinolyticum
  modified_base (897)..(897): a, c, t, g, unknown or other
  modified_base (897)..(897): a, c, t, g, unknown or other
  modified_base (1440)..(1440): a, c, t, g, unknown or other
  modified_base (1440)..(1440): a, c, t, g, unknown or other
  modified_base (1449)..(1449): a, c, t, g, unknown or other
  modified_base (1449)..(1449): a, c, t, g, unknown or other
  modified_base (1458)..(1458): a, c, t, g, unknown or other
  modified_base (1458)..(1458): a, c, t, g, unknown or other
aacgaacgctggcggcgcgtcttaaacatgcaagtcgaacggtaaggaaggagcttgctcctttctgagagtggcggactggtgagtaacacgtgggtgacataccttttagatggggatagctattagaaatagtaggtaataccgaatgtgaccgtatctgttagagggatacgaggaaaggagctaaggcttcgctaaaagaatggcccgcggcccattatgctcgttggtgaggtaacggcccaccaaggcgatgatgggtatccggcctgagagggtggacggacacattgggactgagatacggcccagacttctacgggaggcagcagttaagaatattccgcaatggacgaaagtctgacggagcgacgccgcgtggatgaagaatgccgaaaggttgtaaaatccttttaagcctgaggaataagcacagtagggaatgattgtgtggtgactgtagggcttgaataagcaccggcaaattacgtgccagcagccgcggtaacacgtaaggtgcgagcgttgttcggaattattgggcgtaaagggcatgtaggcggatgagcaagcttggtgtgaaatgctacagcttaactgtgggacagcattgagaactgcacatcttgaattactgaagggtaactagaattccacgtgtaggggtgaaatctgtagatatgtggaagaataccaatggcgaaggcaagttaccggcagataattgacgctgaggtgcgaaagtgcggggagcgaacaggattagataccctggtagtccgcacagtaaacgatgtacactaggtgtctggcaacaaagctgggtgccaaagcaaacgtggtaagtgtaccgcctggggagtatgcccgcaagggtgaaactcaaaggaattnacgggggcccgcacaagcggtggagcatgtggtttaattcgatggtacgcgaggaaccttacctgggtttgacatagtacttaagttcgtagagatacggatgcgtagcaatacgaagtacaacaggtgctgcatggctgtcgtcagctcgtgccgtgaggtgttgggttaagtcccgcaacgagcgcaacccctactgccagttactaacaggtaatgcttgaggactctggcggaactgccggtgacaaaccggaggaaggtggggatgacgtcaagtcatcatggcccttatgtccagggctacacacgtgctacaatggtagcgacagagtgaagcgaagccgcgaggtggagcaaaacgcagaaaagctatcgtagttcggattggagtctgaaactcgactccatgaagttggaatcgctagtaatcgcatatcagcacgatgcggtgaatacgttcccgggccttgtacacaccgcccgtcacaccatccgagtagagggtacccgaagtcggtagtctaaccgcaaggaggacgntgccgaagntatgctttntaaggagggtgaagtcgtaac

SEQ ID NO: 1932 - DNA, 1548 bp, Treponema pallidum
atggagagtttgatcctggctcagaacgaacgctggcggtgcgttttaagcatgcaagtcgaacggcaaggaagcgaattttcgtttctctagagtggcggactggtgagtaacgcgtgggtaatctgcctttgagatggggatagcctctagaaatagggggtaataccgaatacgctcttttggacgtaggtctttgagaggaaaggggctgcggcctcgctcagagatgagcctgcgacccattagcttgttggtggggtaatggcctaccaaggcgtcgatgggtatccgacctgagagggtgaccggacacactgggactgagatacggcccagactcctacgggaggcagcagctaagaatattccgcaatgggcgaaagcctgacggagcgacaccgcgtggatgaggaaggtcgaaagattgtaaagttcttttgccgacgaagaatgaggacgggagggaatgcccgtttgatgacggtagtcgtgcgaataagccccggctaattacgtgccagcagccgcggtaacacgtaaggggcgagcgttgttcggaattattgggcgtaaagggcatgcaggcggactggtaagcctggtgtgaaatccccgagctcaacttgggaactgcactgggtactgctggtctagaatcacggaggggaaaccggaattccaagtgtaggggtggaatctgtagatatttggaagaacaccggtggcgaaggcgggtttctggccgatgattgacgctgaggtgcgaaggtgtggggagcgaacaggattagataccctggtagtccacacagtaaacgatgtacactaggtgttggggcatgagtctcggcgccgacgcgaacgcattaagtgtaccgcctggggagtatgctcgcaagagtgaaactcaaaggaattgacgggggcccgcacaagcggtggagcatgtggtttaattcgatgatacgcgaggaaccttacccgggtttgacatcaagaggagcgccgtagaaatgcggtggcgtagcgatacgcctcttgacaggtgctgcatggctgtcgtcagctcgtgccgtgaggtgttgggttaagtcccgcaacgagcgcaacccctactgccagttgccagcaagtggtgttggggactctggcggaactgccggtgacaaaccggaggaaggtggggatgacgtcaagtcatcatggcccttatgtccggggctacacacgtgctacaatggttgctacagagcgatgcgaggttgtgaagtggagcaaaccgcaaaaaggcaatcgtagtccggattgaagtctgaaactcgacttcatgaagttggaatcgctagtaatcgcacatcagcatggtgcggtgaatgtgttcccgggccttgtacacaccgcccgtcacaccatccgagttggagatacccgaagtcactagcctaacccgcaagggagggcggtgccgaaggtatgtttggtaaggagggtgaagtcgtaacaaggtagccgtaccggaaggtgcggctggatcacctcctttct

SEQ ID NO: 1933 - DNA, 1485 bp, Treponema parvum
gctcagaacgaacgctggcggcgcgtcttaagcatgcaagtcgaacggcaagaggaaagcttgcttttctcctagagtggcggactggtgagtaacacgtgggtgacgaaccctcctgacagggatagctggtagaaatatcagataataccggatacgaactctatagttagagtatagagaggaaaggtgctttggcaccgcagggggatcggctcgcggcctatcagctagttggcagggtaaaggcctgccaaggcgacgacgggtatccggcctgagagggtggacggacacattgggactgagatacggcccagactcctacgggaggcagcagctaagaatattccgcaatgggcgaaagcctgacggagcgacgccgcgtggacgatgaaggccgaaaggttgtaaagtccttttgaacctgaagaataagtttaagagggaatgcttaagcggtgacagaaaggtttgaataagcaacggctaattacgtgccagcagccgcggtaacacgtaagttgcgagcgttgttcggaattattgggcgtaaagggcatctaggcggtcattcaagcttggtgtgaaataccggggcttaactccggggctgcattgagaactggatgactggagtcactgaagggcaaccagaattccaggtgtaggggtgaaatctgtagatatctggaagaataccaatggcgaaggcaggttaccggcagatgactgacgctgaagtgcgaaggtgcggggagcaaacaggattagataccctggtagtccgcacagtcaacaatgtacactcggtgtccggccaagaggctgggtgccaaagcaaacgcgataagtgtaccgcctggggagtatgcccgcaagggtgaaactcaaaggaattgacgggggcccgcacaagcggtggagcatgtggtttaattcgatggtacgcgaggaaccttacctgggtttgacatacacagcgatcatatagagatatgtgagcgtagcaatacggctgtgaacaggtgctgcatggctgtcgtcagctcgtgccgtgaggtgttgggttaagtcccgcaacgagcgcaacccctactgccagttaccagcatgtaaagatggggactctggcggaactgccggtgacaaaccggaggaaggtggggatgacgtcaagtcatcatggcccttatgtccagggcaacacacgtgctacaatggtcgcgacagagtgaagcgaagtcgagaggcgaagcaaaacgcataaaagcgatcgtagtccggattggagtctgaaacccgactccatgaagttggaatcgctagtaatcgcacatcagcacggtgcggtgaatacgttcccgggccttgtacacaccgcccgtcacaccatccgagtaaaggatacccgaagccagtggttcaaccgcaaggagggcgctgtcgaaggtatgctttgtaaggggggtgaagtcgtaacaa

SEQ ID NO: 1934 - DNA, 1547 bp, Treponema phagedenis
tggagagtttgatcctggctcagaacgaacgctggcggcgcgtcttaagcatgcaagtcgaacggcaagggaggagcttgcttctcccctagagtggcggactggtgagtaacgcgtgggtgatctacccttaagatggggatagctcctagaaataggaggtaataccgaatacgcttatacggataaagccgtataaggaaaggaggctgcggccttgcttgaggatgagcccgcgtcccattatgcttgttggtgaggtaacggcttaccaaggcgacgatgggtatccggcctgagagggtggacggacacattgggactgagatacggcccaaactcctacgggaggcagcagctaagaatattccgcaatggacggaagtctgacggagcgacgccgcgtggacgaagaaggccgaaaggttgtaaagttcttttgccgatgaagaataagaggatgagggaatgcgtccttgatgacggtagtcgagcgaataagccccggctaattacgtgccagcagccgcggtaacacgtaaggggcgagcgttgttcggaattattgggcgtaaagggcacgcaggcgggttggtaagcctgatgtgaaatactcaagcttaacttgagaattgcattgggtactgccagtcttgaatcacggaggggaaaccggaattccaagtgtaggggtggaatctgtagatatttggaagaacaccggtggcgaaggcgggtttctggccgatgattgacgctgaggtgcgaaggtgtggggagcaaacaggattagataccctggtagtccacacagtaaacgatgtacactaggtgttggggcaagagcttcagtgccggcgcaaacgcaataagtgtaccgcctggggagtatgcccgcaagggtgaaactcaaaggaattgacgggggcccgcacaagcggtggagcatgtggtttaattcgatgatacgcgaggaatcttacctgggtttgacatcaaaagcaatattatagagatatggtagcgtagcaatacggcttttgacaggtgctgcatggctgtcgtcagctcgtgccgtgaggtgttgggttaagtcccgcaacgagcgcaacccctactgtcagttgctaacaggtaaagctgaggactctggcggaactgccgatgacaaatcggaggaaggtggggatgacgtcaagtcatcatggcccttatgtccagggctacacacgtgctacaatggttgctacaaagtgaagcgagactgtgaggttaagcaaatcgcaaaaaagcaatcgtagttcggattgaagtctgaaactcgacttcatgaagttggaatcgctagtaatcgcacatcagcacggtgcggtgaatacgttcccgggccttgtacacaccgcccgtcacaccatccgagttgagggtacccgaagtcgccagtctaacccgtaagggagggcggtgccgaaggtatgtttggcaaggagggtgaagtcgtaacaaggtagccgtaccggaaggtgcggctggatcacctcctttct

SEQ ID NO: 1935 - DNA, 1260 bp, Treponema putidum
agtggcggactggtgagtaacgcgtgggtgacctgccctgaagatggggatagctagtagaaatattagataataccgaatgtggaaagccgctttaggatgggcctgcgtcccattagctagttggtgaggtaaaggctcaccaaggcaacgatgggtatccggcctgagagggtgaacggacacattgggactgagatacggcccaaactcctacgggaggcagcagctaagaatcttccgcaatggacgaaagtctgacggagcgacgccgtgtgaatgaagaaggccgaaaggttgtaaaattcttttgcagatgaagatgacggtagtctgcgaataagccccggctaattacgtgccagcagccgcggtaacacgtaaggggcgagcgttgttcggaattattgggcgtaaagggtatgtaggcggttaggtaagcctggtgtgaaatctacgagctcaactcgtaaactgcattgggtactgcttaacttgaatcacggaggggaaaccggaattccaagtgtaggggtggaatctgtagatatttggaagaacaccggtggcgaaggcgggtttctggccgaattgacgctgatatacgaaggtgcggggagcaaacaggattagataccctggtagtccgcacagtaaacgatgtacactaggtgtcggggcttcggtgccgacgcaaacgcattaagtgtaccgcctgggaagtatgcccgcaagggtgaaactcaaaggaattgacgggggcccacacaagcggtggagcatgtggtttaattcgatgatacgcgaggaaccttacctgggtttgacatcgacaggtgctgcatggctgtcgtcagctcgtgccgtgaggtgttgggttaagtcccgcaacgagcgcaacccctactgccagttactaacagctgaggactctggcggaactgccgatgacaaatcggaggaaggtggggatgacgtcaagtcatcatggcccttacgtccagggctacacacgtgctacaatggttgccaaatcgaagcgacaccgcgaggtcaagcaaaacgcaagcaatcgtagtccggatgaagtctgaaactcgacttcagaagttggaatcgctagtaatcgcacatcagcacggtgcggtgaatacgttcctgggccttgtacacaccgcccgtcacaccatccgagtcgagggtacccgaagtcgctgtctaggacggtgccgaaggtacgtttggtaaggagggtgaagt

SEQ ID NO: 1936 - DNA, 1455 bp, Treponema refringens
  modified_base (1447)..(1447): a, c, t, g, unknown or other
  modified_base (1447)..(1447): a, c, t, g, unknown or other
  modified_base (1454)..(1454): a, c, t, g, unknown or other
  modified_base (1454)..(1454): a, c, t, g, unknown or other
acgaacgctggcggcgcgttttaagcatgcaagtcgaacggcaaggtaagagcttgctcttaccctagagtggcggactggtgagtaacgcgtgggtaatctacctttaggatggggatagctactagaaatagtagataataccgaatgtgcttatatgttaaatcatgtaaggaaagggagctaaggctttgcctaaagaagagctcgcgtcccattagctagttggtatggtaagagcgtaccaaggcaacgatgggtatccgacctgagagggtgatcggacacattgggactgagacacagcccagactcctacgggaggcagcagctaagaatcttccgcaatgggcgcaagcctgacggagcgacgccgcgtgaatgaagaaggccgaaaggttgtaaaattcttttaagtttgaagaataatcagtrtagggaatgatactgagatgacggtaaaacttgaataagccccggctaattacgtgccagcagccgcggtaacacgtaaggggcgagcgttgttcggaattattgggcgtaaagggtatgcaggcggttagataagcccgatgtgaaatgctcaagcttaacttgagaactgcattaggtactgtttaacttgaatcacgaaggggaaactggaattccgggtgtaggggtggaatctgtagatatccggaggaataccggtggcgaaggcgggtttctggtcgatgattgacgctgagatacgaaagtgtggggagcaaacaggattagatgccctggtagtccacaccataaacgatgtacactaggtgttggggcaagagcttcagtgccgaagcaaacgtgataagtgtaccgcctggggagtatgccggcaacggtgaaactcaaaggaattgacgggggcccgcacaagcggtggagcatgtggtttaattcgaggatacgcgaggaaccttacctgggtttgacatcaagagtaatacggtagagatactgtagcgtagcaatacgacttttgacaggtgctgcatggctgtcgtcagctcgtgccgtgaggtgttgggttaagtcccgcaacgagcgcaacccctactgccagttactaacaggtgaagctgaggactctggcggaactgccgatgacaaatcggaggaaggtggggatgacgtcaagtcatcatggcccttatgcccagggctacacacgtgctacaatggttgctacagaatgaagctaaactgcgaagtggagcgaaacgtaaaaaagcaatcgtagtccggattgaagtctgaaacccgacttcatgaagttggaatcgctagtaatcgcacatcagcacggtgcggtgaatacgttcctgggccttgtacacaccgcccgtcacaccatccgagtcgaagatacccgaagtcgcttgtttaacccgcaagggaggacggtgccgaaggnatgtttng

SEQ ID NO: 1937 - DNA, 1477 bp, Treponema socranskii
  modified_base (1458)..(1458): a, c, t, g, unknown or other
  modified_base (1458)..(1458): a, c, t, g, unknown or other
gctcagaacgaacgctggcggcgcgtcttaaccatgcaagtcgagcggcaggcagcaatgccgagagcggcggactggtgagtaacacgtggataacgtaccccgatgcccgggacagcctgtagaaatagagggtgataccggatagatcactgtatacggaaggtagacagcgggaaaggagcttcggctccgcgccgggaacggtctgcggcccatcagctggacggcggggtaacggcccgccgtggcgaggacgggtatccggcctgagagggcggacggacacattgggactgagatacggcccagactcctacgggaggcagcaggtaagaatattccgcaatggggggaaccctgacggagcgacgccgcgtgaacgaagaaggccggaaggttgtaaagttcttttctgtccgaggaataagtgtaggaggaaatgcctgcatggtgacggtaggacaggaataagcaccggctaattacgtgccagcagccgcggtaacacgtaaggtgcgagcgttgttcggaattattgggcgtaaagggcatgcaggcgggtcgccaagcttggtaagaaataccggggctcaactccggagctatattgagaactggcgagctggagttgccgaagggtatccggaattccgcgtgaaggggtgaaatctgtagatatgcggaagaacaccgatggcgaaggcaggataccggcggacgactgacgctgaggtgcgaaggtgcggggagcaaacaggattagataccctggtagtccgcacagtcaacgatgtacactgggcgtgtgcgcaagagcgtgcgtgccgaagcaaacgcgataagtgtaccgcctggggagtatgcccgcaagggtgaaactcaaaggaattgacgggggcccgcacaagcggtggagcatgtggtttaattcgatggtacgcgaggaaccttacctgggtttgacatcaagagggatcatatagagatatgtgagcgtagcaatacggctcttgacaggtgctgcatggctgtcgtcagctcgtgccgtgaggtgttgggttaagtcccgcaacgagcgcaacccctactgccggttactaacaggtaaagctgaggactcaggcggaactgcctgcgacaagcaggaggaaggcggggacgacgtcaagtcatcatggcccttatgtccagggctacacacgtgctacaatggccgccacagagcgaggcgaagccgagaggcggagcagaacgcagaaaagcggtcgtagtccggattgaagtctgaaactcgacttcatgaagctggaatcgctagtaaccgcacatcagcacggcgcggtgaatacgttcccgggccttgtacacaccgcccgtcacaccatccgagcagggggtacccgaagccggcagtccaaccgcaagggggacgctgtcgaaggtacgctttgtgangggggtgaagtcgtaacaa

SEQ ID NO: 1938 - DNA, 1498 bp, Treponema sp.
  6:H:D15A-4
cggcgcgtcttaaccatgcaagtcgagcggcaggcagcaatgccgagagcggcggactggtgagtaacacgtggataacgtaccccgatgcccgggacagcctgtagaaatagagggtaataccggataggtcaccatattcgcaagggatatggcgggaaaggagcttcggctccgcgccgggaacggtctgcggcccatcagctggacggcggggtaaaagcccgccgtggcgaggacgggtatccggcctgagagggcggacggacacattgggactgagatacggcccagactcctacgggaggcagcaggtaagaatattccgcaatggggggaaccctgacggagcgacgccgcgtgaacgaagaaggccggaaggttgtaaagttcttttctgttcgaggaataagtgtaggaggaaatgcctgcatggtgacggtagggcaggaataagcaccggctaattacgtgccagcagccgcggtaacacgtaaggtgcgagcgttgttcggaattattgggcgtaaagggcatgcaggcgggtcgccaagcttgatgagaaataccggggctcaactccggagctatattgagaactggcgagctagagttgccgaagggtatccggaattccgcgtgaaggggtgaaatctgtagatatgcggaagaacaccgatggcgaaggcaggataccggcggacgactgacgctgaggtgcgaaggtgcggggagcaaacaggattagataccctggtagtccgcacagtcaacgatgtacactgggcgtgtgcgcaagagcgtgcgtgccgaagcaaacgcgataagtgtaccgcctggggagtatgcccgcaagggtgaaactcaaaggaattgacgggggcccgcacaagcggtggagcatgtggtttaattcgatggtacgcgaggaaccttacctgggtttgacatacacagcaatcatatagagatatgtgagcgtagcaatacggctgtgaacaggtgctgcatggctgtcgtcagctcgtgccgtgaggtgttgggttaagtcccgcaacgagcgcaacccctactgccggttactaacaggtaaagctgaggactcaggcggaactgcctgcgacaagcaggaggaaggcggggacgacgtcaagtcatcatggcccttatgtccagggctacacacgtgctacaatggccgccacagagcggggcgaagccgagaggcggagcagaacgcagaaaagcggtcgtagtccggattgaagtctgaaactcgacttcatgaagctggaatcgctagtaaccgcacatcagcacggcgcggtgaatacgttcccgggccttgtacacaccgcccgtcacaccatccgagcagggggtacccgaagccggcagtccaaccgcaagggggacgctgtcgaaggtacgctttgtgaggggggtgaagtcgtaacaaggtagtcgtaccggaaggtgcggctggawcacctccttc

SEQ ID NO: 1939 - DNA, 1404 bp, Treponema sp.
  clone DDKL-4
  modified_base (821)..(821): a, c, t, g, unknown or other
  modified_base (821)..(821): a, c, t, g, unknown or other
  modified_base (831)..(831): a, c, t, g, unknown or other
  modified_base (831)..(831): a, c, t, g, unknown or other
  modified_base (840)..(841): a, c, t, g, unknown or other
  modified_base (840)..(841): a, c, t, g, unknown or other
  modified_base (843)..(843): a, c, t, g, unknown or other
  modified_base (843)..(843): a, c, t, g, unknown or other
  modified_base (886)..(886): a, c, t, g, unknown or other
  modified_base (886)..(886): a, c, t, g, unknown or other
tagagtggcggactggtgagtaacgcgtgggtgatctgcccttaagatggggatagctcctagaaataggaggtaataccgaatacgcttatacggataaagccgtataaggaaaggaggctacggccttgcttgaggatgagcccgcgtcccattatgcttgttggtgaggtaacggcttaccaaggcgacgatgggtatccggcctgagagggtggacggacacattgggactgagatacggcccaaactcctacgggaggcagcagctaagaatattccgcaatggacggaagtctgacggagcgacgccgcgtggacgaagaaggccgaaaggttgtaaagttcttttgccgatgaagaataagaggatgagggaatgcgtccttgatgacggtagtcgagcgaataagccccggctaattacgtgccagcagccgcggtaacacgtaaggggcgagcgttgttcggaattattgggcgtaaagggcacgcaggcgggttggtaagcctgatgtgaaatactcaagcttaacttgagaattgcattgggtactgccagtsttgaatcacggaggggaaaccggaattccaagtgtaggggtggaatctgtagatatttggaagaacaccggtggcgaaggcgggtttctggccgatgattgacgctgaggtgcgaaggtgtggggagcaaacaggattagataccctggtagtccacacagtaaacgatgtacactaggtgttgggcaagagcttcagtgccggcgcaaacgcaataagtgtaccgcctggggagtatgcccgcaagggtgaaactnaaaggaattnacgggggcnngnacaagcggtggagcatgtggtttaattcgatgatacgcgaggnatcttacctgggtttgacatcaaaagcaatattatagagatatggtagcgtagcaatacggcttttgacaggtgctgcatggctgtcgtcagctcgtgccgtgaggtgttgggttaagtcccgcaacgagcgcaacccctactgtcagttgctaacaggtaacgctgaggactctggcggaactgccgatgacaaatcggaggaaggtggggatgacgtcaagtcatcatggcccttatgtccagggctacacacgtgctacaatggttgctacaaagtgaagcgagactgtgaggttaagcaaatcgcaaaaaagcaatcgtagttcggattgaagtctgaaactcgacttcatgaagttggaatcgctagtaatcgcacatcagcacggtgcggtgaatacgttcccgggccttgtacacaccgcccgtcacaccatccgagttgagggtacccgaagtcgccagtctaacccgtaagggagggcggtgccgaaggtatgtttggcaaggagggtg

SEQ ID NO: 1940 - DNA, 1327 bp, Treponema sp.
  oral clone JU025
ggagtttgatcctggctcagaacgaacgctggcggcgcgtcttaaacatgcaagtcgaacgagtggcggactggtgagtaacacgtgggtgatataccttttagttggggatagctgttagaaatagcaggtaataccgaatgtggaaagccgctagaagaatggctcgcggcccattagctcgttggtgaggtaacggcccaccaaggcaatgatgggtatccggcctgagagggtgaacggacacattgggactgagatacggcccagacttctacgggaggcagcagttaagaatattccgcaatggacgaaagtctgacggagcgacgccgcgtggatgaagaatgccgaaaggttgtaaaatccttttaagcctgaggatgacagtagggcttgaataagcaacggctaattacgtgccagcagccgcggtaacacgtaagttgcgagcgttgttcggaattattgggcgtaaagggcatgtaggcggatatgcaagcttggtgtgaaatactgcagcttaactgcggaactgcattgagaactgcacatcttgaattactgaagggtaaccagaattccacgtgtaggggtgaaatctgtagatatgtggaagaataccaatggcgaaggcaggttaccggcagaattgacgctgaggtgcgaaagtgcggggagcgaacaggattagataccctggtagtccgcaccgtaaacgatgtacactaggtgtccggcgctgggtgccaaagcaaacgtgataagtgtaccgcctggggagtatgcccgcaagggtgaaactcaaaggaattgacgggggcccgcacaagcggtggagcatgtggtttaattcgatggtacgcgaggaaccttacctgggtttgacataaacaggtgctgcatggctgtcgtcagctcgtgccgtgaggtgttgggttaagtcccgcaacgagcgcaacccctactgccagttactaacagctgaggactctggcggaactgccggtgacaaaccggaggaaggtggggatgacgtcaagtcatcatggcccttatgtccagggctacacacgtgctacaatggtaggcaaagtgaggcgaagctgtaaagcggagcaaaacgcaaactatcgtagtccggatggagtctgaaactcgactccagaagttggaatcgctagtaatcgcgcatcagcacggcgcggtgaatacgttcccgggccttgtacacaccgcccgtcacaccatccgagtagagggtacccgaagtcggtgtctaggacgctgccgaaggtatgttttgtaaggagggtgaagtcgtaac

SEQ ID NO: 1941 - DNA, 1327 bp, Treponema sp.
  oral clone JU031
ggagtttgatcctggctcagaacgaacgctggcggcgcgtcttaagcatgcaagtcgaacgagtggcggactggtgagtaacacgtgggtgatctacccttgagatggggatagccgttaggaatagcgggtaataccgaatacagaaagtcgctcgaggatgagcttgcgtcccattagctagttggtgaggtaagggcccaccaaggcgacgatgggtatccggcctgagagggtgaacggacacattgggactgagatacggcccaaactcctacgggaggcagcagctaagaatattccgcaatggacggaagtctgacggagcgacgccgcgtggatgaagaaggctgaaaagttgtaaaatccttttgctgatgaagatgacgataatcggcgaataagccccggctaattacgtgccagcagccgcggtaacacgtaaggggcgagcgttgttcggaattattgggcgtaaagggcatgtaggcggttatgtaagcctgatgtgaaatgctggggctcaaccccagaactgcattgggtactgcgtagcttgaattacggaagggaaactggaattccaagtgtaggggtggaatctgtagatatttggaagaacaccggtggcgaaggcgggtttctggccgaattgacgctgagatgcgaaagtgtggggatcgaacaggattagataccctggtagtccacaccgtaaacgatgtacactaggtgctggagcttcagtgccaaagcaaacgtgataagtgtaccgcctggggagtatgcccgcaagggtgaaactcaaagggattgacgggggcccgcacaagcggtggagcatgtggtttaattcgatggtacgcgaggaaccttacctgggttcgacatcgacaggtgctgcatggctgtcgtcagctcgtgccgtgaggtgttgggttaagtcccgcaacgagcgcaacccctactgccagttactagcagctgaggactctggcggaactgccgatgacaaatcggaggaaggtggggatgacgtcaagtcatcatggcccttatgtccagggctacacacgtgctacaatggttgccaaagcgaagcgatgctgtgaggctaagcaaaccgcaagcaatcgtagttcggatgaagtctgaaactcgacttcagaagttggaatcgctagtaatcgcgcatcagcacggcgcggtgaatacgttcccgggccttgtacacaccgcccgtcacaccatccgagttgagggtacccgaagtcgctgtctaggacggtgccgaaggtacgtttggtaaggagggtgaagtcgtaac

SEQ ID NO: 1942 - DNA, 1295 bp, Treponema sp.
  oral clone P2PB_53 P3
aacgaacgctggcggcgcgtcttaagcatgcaagtcgaacgagtggcggactggtgagtaacgcgtgggtgacctgccctgaagatggggatagctagtagaaatattagataataccgaatgtggaaagccgcttcaggatgggcctgcgtcccattagctggttggtgaggtaaaggctcaccaaggcaacgatgggtatccggcctgagagggtgaacggacacattgggactgagatacggcccaaactcctacgggaggcagcagctaagaatcttccgcaatggacgaaagtctgacggagcgacgccgtgtgaatgaagaaggccgaaaggttgtaaaattcttttgcagatgaagatgacggtaatctgcgaataagccccggctaattacgtgccagcagccgcggtaacacgtaaggggcgagcgttgttcggaattattgggcgtaaagggtatgtaggcggttaggtaagcctggtgtgaaatctacgagctcaactcgtaaactgcatcgggtactgcttgacttgaatcacggaggggaaaccggaattccaagtgtaggggtggaatctgtagatatttggaagaacaccggtggcgaaggcgggtttctggccgaattgacgctgatatacgaaggtgcggggagcaaacaggattagataccctggtaatccgcacagtaaacgatgtacactaggtgtcggagcttcggtgccgacgcaaacgcattaagtgtaccgcctgggaagtatgcccgcaagggtgaaactcaaaggaattgacgggggcccacacaagcggtggagcatgtggtttaattcgatgatacgcgagaaaccttacctgggttgacatcgacaggtgctgcatggctgtcgtcagctcgtgccgtgaggtgttgggttaagtcccgcaacgagcgcaacccctactgccagttactaacagctgaggactctggcggaactgccgatgacaaatcggaggaaggtggggatgacgtcaagtcatcatggcccttacgtccagggctacacacgtgctacaatggttgccaaatcgaagcgacaccgcgaggtcaagcaaaacgcagcaatcgtagtccggatgaagtctgaaactcgacttcagaagttggaatcgctagtaatcgcacatcagcacggtgcggtgaatacgttcctgggccttgtacacaccgcccgtcataccatccgagtcgagggtacccgaagtcgctgtctaggacggtgccgaaggtacgtttggtaaggagggtg

SEQ ID NO: 1943 - DNA, 1460 bp, Treponema sp.
  oral taxon 228
aacgaacgctggcggcgcgtcttaagcatgcaagtcgaacggcaagagaggagcttgcttctctcctagagtggcggactggtgaggaacgcgtgggtaatctacccttaagatggggatagccgctagaaatagcgggtaataccaatagacttatagctgagaaagaagtgataaggaaaggaagctaaggcttcgcttaaggatgagcctgcgtcccattagctagttggtaaggtaacggcctaccaaggcgacgatgggtatccggcctgagagggtgaacggacacattgggactgagatacggcccaaactcctacgggaggcagcagctaagaatattccgcaatggacgaaagtctgacggagcgacgccgcgtggatgaagaaggctgaaaagttgtaaaatccttttgttgatgaagaataagggtgagagggaatgttcatctgatgacggtaatcagcgaataagccccggctaattacgtgccagcagccgcggtaacacgtaaggggcgagcgttgttcggaattactgggcgtaaagggcatgtaggcggttatgtaagcctgatgtgaaatcctgaggcttaacctcagaatagcattgggtactgtgtaacttgaattacggaagggaaactggaattccaagtgtaggggtggaatctgtagatatttggaagaacaccggtggcgaaggcgggtttctggccgataattgacgctgagatgcgaaagtgtggggatcgaacaggattagataccctggtagtccacaccgtaaacgatgtacactaggtgttggggcaagagcttcagtgccaaagtaaacgcgataagtgtaccgcctggggagtatgcccgcaagggtgaaactcaaaggaattgacgggggcccgcacaagcggtggagcatgtggtttaattcgatggtacgcgaggaaccttacctgggtttgacatctagtggaatgtcttagagataaggcagtgtagcaatacaccgctagacaggtgctgcatggctgtcgtcagctcgtgccgtgaggtgttgggttaagtcccgcaacgagcgcaacccctactgccagttactaacaggtaaagcttgagactctggcggaactgccgatgacaaatcggaggaaggtggggatgacgtcaagtcatcatggcccttatgtccagggctacacacgtgctacaatggttgctacaaagcgaagcgagaccgtaaggtggagcaaaccgcaaaaaagcaatcgtagttcggattgaagtctgaaactcgacttcatgaagttggaatcgctagtaatcgcgcatcagcacggcgcggtgaatacgttcccgggccttgtacacaccgcccgtcacaccatccgagttgggggtgcccgaagtcgcttgtctaacccgcaagggagacggtgccgaaggtacgcttggta

SEQ ID NO: 1944 - DNA, 1423 bp, Treponema sp.
  oral taxon 230
aacgaacgctggcggcgcgtcttaagcatgcaagtcgaacggcaagagaggagcttgcttctctcctagagtggcggactggtgaggaaccgtgggtaatctacccttaagatggggatagcgtagaaatagcgtaataccgaatactggaggaaagggctaggctcgctaggatgagcgcgtcccattagctagttggtaggtaaggccaccaaggcgacgatgggtatccggcctgagagggtgacggacacattgggactgagatacggcccaaactcctacgggaggcagcagctaagaatattccgcaatggacggtctgacggagcgacgccgcgtggatgaagaaggctgaaaagttgtaaaatccttttgttgatgaggaataagggtgagagggaatgctcatctgatgacggtaatcgacgaataagccccggctaattacgtgccagcagccgcggtaacacgtaaggggcgagcgttgttcggaattattgggcgtaaagggcatgtaggcggttatgtaagcctgatgtgaaatcctggggcttaaccctagaatagcattgggtactgtataacttgaattacggaaggggaactggaattccaagtgtaggggtggaatctgtagatatttggaagaacaccggtggcgaaggcgggtttctggccgataattgacgctgagatgcgaaagtgtggggatcgaacaggattagataccctggtagtccacaccgtaaacgatgtacactaggtgttggggcaagagcttcagtgccaaagcaaacgcgataagtgtaccgcctggggagtatgcccgcaagggtgaaactcaaaggaattgacgggggcccgcacaagcggtggagcatgtggtttaattcgatggtacgcgaggaaccttacctgggtttgacatctagtggaatgccttagagataaggtagtgtagtttactacaccgctagacaggtgctgcatggctgtcgtcagctcgtgccgtgaggtgttgggttaagtcccgcaacgagcgcgacccctattgccagttactaacaggtaaagcttgaggactctggcggaactgccgatgacaaatcggaggaaggtggggatgacgtcaagtcatcatggcccttatgtccagggctacacacgtgctacaatggctgctacaaagcgaggcgagactgtgaaggtgagcaaaccgcaaaaaagcagccgtagttcggattgaagtctgaaactcgacttcatgaagttggaatcgctagtaatcgcgcatcagcacggcgcggtgaatacgttcccgggccttgtacacaccgcccgtcacaccatccgagttgggggtacccgaagtcgctcgtctaacccgtaagggaggacggtgccgaaggtacgcttggtg

SEQ ID NO: 1945 - DNA, 1439 bp, Treponema sp.
  oral taxon 231
aacgaacgctggcggcgcgtcttaagcatgcaagtcgaacggcaagagaggagcttgcttctctcctagagtggcggactggtgaggaacacgtgggtaatctacccttaagatggggatagctgctagaaatagcagataataccgaatacactcggcgcttcataagaggcgttgaggaaaggaagctacggcttcgcttgaggatgagcttgcgtcccattagctagttggtgaggtaacggcccaccaaggcgacgatgggtatccggcctgagagggtgaacggacacattgggactgagatacggcccaaactcctacgggaggcagcagctaagaatattccgcaatggacggaagtctgacggagcgacgccgcgtggatgaagaaggctgaaaagttgtaagatccttttgttgatgaagaataaggatgagagggaatgctcatctgatgacggtaatcgacgaataagccccgttacgtgccagcagccgcggtaacacgtaaggggcgagcgttgttcggaattattgggcgtaaagggcatgtaggcggttatgtaagcctgtgtgaaatctgggcttaaccctgaaagcattgggtactgttacttgaattacggaagggaactgaattccaagtgtaggggtggaatctgtgatatttggaagaacaccggtggcgaaggcgggtttctggccgataattgacgctgagtgcgaaagtgtggggatcgaacaggattagataccctggtagtccacactgtaaacgatgtacactaggtgttgggaagagcttcagtgccaaagaaacggataagtgtaccgcctggggagtatgcccgcaagggtgaaactcaaaggaattgacgggggcccgcacaagcggtggagcatgtggtttaattcgatggtacgcgaggaaccttacctgggtttgacatctaggagtagagataagtagcaataccgctagacaggtgctgcatggctgtcgtcagctcgtgccgtgaggtgttgggttaagtcccgcaacgagcgcaacccctactgccagttactaacaggtaaagcttgaggactctggcggaactgccgatgacaaatcggaggaaggtggggatgacgtcaagtcatcatggcccttatgtccagggctacacacgtgctacaatggttctacaaagcgagcaaccgtaggggagcaaaccgcaaaaaagcaatcgtagttcggattgaagtctgaaactcgacttcatgaagttggaatcgctagtaatcgcgcatcagcacggtgcggtgaatacgttcccgggccttgtacacaccgcccgtcacaccatccgagttgggggtacccgaagtcgcttgtctaaccgcaaggggacggtgccgaggtacgcttggtaaggagggtgaagtcgtaacaa

SEQ ID NO: 1946 - DNA, 1482 bp, Treponema sp.
  oral taxon 232
aacgaacgctggcggcgcgtcttaagcatgcaagtcgaacggcaagagaggagcttgcttctctcctagagtggcggactggtgaggaacgcgtgggtaatctacccttaagatggggatagccgctagaaatagcgggtaataccgaatagacttatagctgagaaagaagtgataaggaaaggaagctaaggcttcgcttaaggatgagcctgcgtcccattagctagttggtaaggtaacggcctaccaaggcgacgatgggtatccggcctgagagggtgaacggacacattgggactgagatacggcccaaactcctacgggaggcagcagctaagaatattccgcaatggacggaagtctgacggagcgacaccgcgtggatgaagaaggctgaaaagttgtaaaattcttttgctgatgaagaataaagataagagggaatgcttatcagatgacggtagtcggcgaataagccccggctaattacgtgccagcagccgcggtaacacgtaaggggcgagcgttgttcggaattattgggcgtaaagggcatgcaggcggttgtgtaagcctgatgtgaaatcctgaggcttaaccttggggctgcattgggtactgcacgacttgaattacggaaggggaactggaattccaagtgtaggggtggaatctgtagatatttggaagaacaccggtggcgaaggcgggtttctggccgataattgacgctgagatgcgaaagtgtggggatcgaacaggattagataccctggtagtccacactgtaaacgatgtacactaggtgttggggtaacaatctcagtgccgaagcaaacgtgataagtgtaccgcctggggagtatgcccgcaagggtgaaactcaaaggaattgacgggggcccgcacaagcggtggagcatgtggtttaattcgatggtacgcgaggaatcttacctgggtttgacatctagtgggatactttagagataaggtagtgtagcaatacaccgctagacaggtgctgcatggctgtcgtcagctcgtgccgtgaggtgttgggttaagtcccgcaacgagcgcaacccctactgccagttactaacaggtaaagcttgaggactctggcggaactgccgatgacaaatcggaggaaggtggggatgacgtcaagtcatcatggcccttatgtccagggctacacacgtgctacaatggctgctacaaagcgaggcgagactgtgaaggtgagcaaaccgcaaaaaagcagccgtagttcggattgaagtctgaaactcgacttcatgaagttggaatcgctagtaatcgcgcatcagcacggcgcggtgaatacgttcccgggccttgtacacaccgcccgtcacaccatccgagttgagggtacccgaagtcgcttgtctaacccgcaagggaggacggtgccgaaggtatgcttggtgaggagggtgaagtcgtaac

SEQ ID NO: 1947 - DNA, 1480 bp, Treponema sp.
  oral taxon 235
aacgaacgctggcggcgcgtcttaagcatgcaagtcgaacggcaagagaggagcttgcttctctcctagagtggcggactggtgaggaacacgtgggtaatctacccttaagatggggatagctgctagaaatagcagataataccgaatacactcaatttttcataagaggagttgaggaaagaggctacggcctcgcttaaggatgagcttgcgtcccattagctagttggtgaggtaaaggctcaccaaggcgacgatgggtatccggcctgagagggtgaacggacacattgggactgagatacggcccaaactcctacgggaggcagcagctaagaatattccgcaatggacggaagtctgacggagcgacgccgcgtggatgaagaaggctgaaaagttgtaaaatccttttgttgatgaagaataagggtaagagggaatgcttgcctgatgacggtaatcggcgaataagccccggctaattacgtgccagcagccgcggtaacacgtaaggggcgagcgttgttcggaattattgggcgtaaagggcatgtaggcggttatgtaagcctgatgtgaaatgccggggcttaaccccggaacagcattgggtactgtataacttgaattacggaagggaaactggaattccaagtgtaggggtggaatctgtagatatttggaagaacaccggtggcgaaggcgggtttctggccgataattgacgctgagatgcgaaagtgtggggatcgaacaggattagataccctggtagtccacaccgtaaacgatgtacactaggtgttggggcaagagcttcagtgccaaagcaaacgcgataagtgtaccgcctggggagtatgcccgcaagggtgaaactcaaaggaattgacgggggcccgcacaagcggtggagcatgtggtttaattcgatggtacgcgaggaaccttacctgggtttgacatctagaggaatactgtagagatacggtagcgtagcaatacgccgctagacaggtgctgcatggctgtcgtcagctcgtgccgtgaggtgttgggttaagtcccgcaacgagcgcaacccctactgccagttactaacaggtaacgcttgaggactctggcggaactgccgatgacaaatcggaggaaggtggggatgacgtcaagtcatcatggcccttatgtccagggctacacacgtgctacaatggttgctacaaagcgaagcaagaccgtaaggtggagcaaaccgcaaaaaagcaatcgtagttcggattgaagtctgaaactcgacttcatgaagttggaatcgctagtaatcgcgcatcagcacggcgcggtgaatacgttcccgggccttgtacacaccgcccgtcacaccatccgagttgggggtacccgaagtcgcttgtctaacctgcaaagggggacggtgccgagggtacgcttggtaaggagggtgaagtcgtaa

SEQ ID NO: 1948 - DNA, 1461 bp, Treponema sp.
  oral taxon 239
aacgaacgctggcggcgcgtcttaagcatgcaagtcgaacggcaagagaggagcttgcttctctcctagagtggcggactggtgaggaacacgtgggtaatctacccttaagatggggatagctgctagaaatagcaggtaataccgaataccctcacgttcataaagggatgtgaggaaaggaagctacggcttcgctcgaggatgagcctgcgtcccattagctagttggtgaggtaaaggcccaccaaggcgacgatgggtatccggcctgagagggtgatcggacacattgggactgagatacggcccaaactcctacgggaggcagcagctaagaatattccgcaatggacggaagtctgacggagcgacgccgcgtggatgaagaaggctgaaaagttgtaaaatccttttgctgatgaagaataagggtaggagggaatgcctatctgatgacggtaatcggcgaataagccccggctaattacgtgccagcagccgcggtaacacgtaaggggcgagcgttgttcggaattattgggcgtaaagggcatgtaggcggttatgtaagcctgatgtgaaatactggggctcaaccccagaactgcattgggtactgcgtagcttgaattacggaagggaaactggaattccaagtgtaggggtggaatctgtagatatttggaagaacaccggtggcgaaggcgggtttctggccgataattgacgctgagatgcgaaagtgtggggatcgaacaggattagataccctggtagtccacaccgtaaacgatgtacactaggtgctggagtggaagcttcagtgccaaagcaaacgtgataagtgtaccgcctggggagtatgcccgcaagggtgaaactcaaaggaattgacgggggcccgcacaagcggtggagcatgtggtttaattcgatggtacgcgaggaaccttacctgggtttgacatctagtggaatgttttagagataagacagtgtagcaatacaccgctagacaggtgctgcatggctgtcgccagctcgtgccgtgaggtgttgggttaagtcccgcaacgagcgcaacccctactgccagttactaacaggtaaagcttgaggactctggcggaactgccgatgacaaatcggaggaaggtggggatgacgtcaagtcatcatggcccttatgtccagggctacacacgtgctacaatggttgctacaaagcgaagcgatgctgtgaggctaagcaaaccgcaaaaaagcaatcgtagttcggattgaagtctgaaactcgacttcatgaagttggaatcgctagtaatcgcgcatcagcacggcgcggtgaatacgttcccgggccttgtacacaccgcccgtcacaccatccgagttgagggtacccgaagtcgctcgtctaacctgcaaaggaggacggtgccgaaggtacgtttggta

SEQ ID NO: 1949 - DNA, 1463 bp, Treponema sp.
  oral taxon 247
aacgaacgctgacggcgcgtcttaagcatgcaagtcgaacggtaagagaggagcctaggtgttctcctagagtggcggactggtgagtaacgcgtgggtgacctgccctaaagatggggatagctagtagaaatattagataataccgaatgtgctcatttacataaaggtagatgaggaaagggggctacggctccgctttaggatgggcccgcgtcccattagctcgttggtgaggtaacggcccaccaaggcaacgatgggtatccggcctgagagggtgaacggacacattgggactgagatacggcccaaactcctacgggaggcagcagctaagaatcttccgcaatggacgaaagtctgacggagcgacgccgtgtgaatgaagaaggccgaaaggttgtaaaattcttttgcagatgaagaataaggataagagggaatgcttgtccgatgacggtagttatgcgaataagccccggctaattacgtgccagcagccgcggtaacacgtaaggggcgagcgttgttcggaattattgggcgtaaagggcatgtaggcggttaggtaagcctgatgtgaaatctacgagcttaactcgtaaactgcattgggtactgcttgacttgaatcacggaggggaaaccggaattccaagtgtaggggtggaatctgtagatatttggaagaacaccggtggcgaaggcgggtttctggccgatgattgacgctgatatgcgaaggtgcggggagcaaacaggattagataccctggtagtccgcacagtaaacgatgtacactaggtgttggggcaagagcttcagtgcctaagcaaacgcaataagtgtaccgcctgggaagtatgcccgcaagggtgaaactcaaaggaattgacgggggcccacacaagcggtggagcatgtggtttaattcgatgatacgcgaggaaccttacctgggtttgacatcaagagcaatactatagagatatggtagcgtagcaatacggctcttgacaggtgctgcatggctgtcgtcagctcgtgccgtgaggtgttgggttaagtcccgcaacgagcgcaacccctactgccagttactaacaggtaaagcttgaggactctggcggaactgccgatgacaaatcggaggaaggtggggatgacgtcaagtcatcatggcccttacgtccagggctacacacgtgctacaatggttgctacaaatcgatgcaaaaccgtgaggtcaagcaaaacgcaaaaaagcaatcgtagtccggattgaagtctgaaactcgacttcatgaagttggaatcgctagtaatcgcacatcagcacggtgcggtgaatacgttcctgggccttgtacacaccgcccgtcacaccatccgagtcgagggtacccgaagtcgccagtctaacctgcaaagggggacgacgccgaaggtacgcttggta

SEQ ID NO: 1950 - DNA, 1470 bp, Treponema sp.
  oral taxon 250
aacgaacgctggcggtgcgtcttaagcatgcaagtcgaacggtaagaggggagcttagctcccttcctagagtggcggactggtgagtaacgcgtggatgatctacctttgagatggggatagcttctagaaataggagataataccgaataaccttattgcgttttgatgtagtaagaaaaggagcgtcagctccgcttaaagatgagtctgcgtcccattagctagttggtaaggtaaaggcctaccaaggcgacgatgggtacccggcctgagagggtgaacgggcacattgggactgagatacggcccaaactcctacgggaggcagcagctgagaatcttccgcaatggacgaaagtctgatggagcgacaccgcgtgaacgatgaaggccggaaggttgtaaagttcttttgcagacaaagaataaggatagaaggaaatgactatctgatgacggtagttatgcgaataagccccggctaattacgtgccagcagccgcggtaatacgtaaggggcgagcgttgttcggaattattgggcgtaaagggcatgtaggcggttaggtaagcctgatgtgaaatgtatgagcttaactcataaactgcattgggtactgcttgacttgaatcatggaggggaaactggaattccaagtgtaggggtggaatctgtagatatttggaagaacaccggtggcgaaggcgggtttctagccaatgattgacgctaaggtgcgaaggtgcggggagcaaacaggattagataccctggtagtccgcacagtaaacgatgtacactaggtgttggggtaagactcagtgccgaaagcaaacgcaataagtgtaccgcctggggagtatgcccgcaagggtgaaactcaaaggaattgacgggggcccacacaagcggtggagcatgtggtttaattcgatgatacgcgaggaaccttacctgggtttgacatcaagagggatactgtagagatatggtagcgtagcaatacgactcttgacaggtgctgcatggctgtcgtcagctcgtgccgtgaggtgttgggttaagtcccgcaacgagcgcaacccctactgccagttactaacaggtaaagcttgaggactctggcggaactgccggtgataaaccggaggaaggtggggatgacgtcaagtcatcatggcccttatgtccagggctacacacgtgctacaatggttgttacaaagtgaagcgaagccgcgaggttaagcgaatggcaaaaaagcaatcgtagtccagattggaatctgaaacctgattccatgaagctggaatcgctagtaatcgcatatcagcacgatgcggtgaatacgttcctgggccttgtacacaccgcccgtcacaccatccgagtcgaaggtacccgaagacgctagtctaaccgtaaggaggacggtggcgaaggtacgtttggtaaggagggtgaa

SEQ ID NO: 1951 - DNA, 1461 bp, Treponema sp.
  oral taxon 251
aacgaacgctggcggtgcgtcttaagcatgcaagtcgaacggtaagaagagagcttgctcttttcctagagtggcggactggtgagtaacgcgtggatgatctacctttaagatggggatagcttctagaaataggagataataccgaataaccttatcgtgttatgacgtgataagaaaatggagcgttagctccgcttgaagatgagtctgcgtcccattagctagttggtagggtaaaggcttaccaaggcgatgatgggtatccggcctgagagggtgaacggacacattgggactgagacacggcccaaactcctacgggaggcagcagctgagaatcttccgcaatggacgaaagtctgacggagcgacaccgcgtgaacgatgaaggccggaaggttgtaaagttcttttgcagacaaagaataaggatagaaggaaatgactatctgatgacggtagttatgcgaataagccccggctaattacgtgccagcagccgcggtaatacgtaaggggcgagcgttgttcggaattattgggcgtaaagggcatgtaggcggttaggtaagcctgatgtgaaatgtatgagcttaactcataaactgcattgggtactgcttgacttgaatcatggaggggaaactggaattccaagtgtaggggtggaatctgtagatatttggaagaacaccggtggcgaaggcgggtttctagccaatgattgacgctaaggtgcgaaggtgcggggagcaaacaggattagataccctggtagtccgcacagtaaacgatgtacactaggtgttggggtaagactcagtgccaaagcaaacgcaataagtgtaccgcctggggagtatgcctgcaagggtgaaactcaaaggaattgacgggggcccacacaagcggtggagcatgtggtttaattcgatgatacgcgaggaaccttacctgggtttgacatcaagagggatgctatagagatatggtagcgtagtaatacgtctcttgacaggtgctgcatggctgtcgtcagctcgtgccgtgaggtgttgggttaagtcccgcaacgagcgcaacccctactgccagttactaacaggtaaagctgaggactcaggcggaactgccggtgataaaccggaggaaggtggggatgacgtcaagtcatcatggcccttatgtccagggctacacacgtgctacaatggttgttacaaagtgaagcgaagccgcgaggttgagcgaatcgcaaaaaagcaatcgtagtccggattggaatctgaaacctgattccatgaagctggaatcgctagtaatcgcatatcagcacgatgcggtgaatacgttcctgggccttgtacacaccgcccgtcacaccatccgagtcgaaggtacccgaagacgctagtctaaccgtaaggaggacggtggcgaaggtatgtttggtaagga

SEQ ID NO: 1952 - DNA, 1382 bp, Treponema sp.
  oral taxon 254
aacgaacgctggcggtgcgtcttaagcatgcaagtcgaacggcaagaaagtgcttgcactttcctagagtggcggactggtgagtaacgcgtgggtgatctacctttaagatggggatagcttttagaaataagagataataccgaatgtgcttgcgatgctttggcgttgcaaggaaaggagcgtttgctcgcttaaagatgagcctgcgtcccattagctagttggtgaggtaatggcccaccaaggcgatgatgggtatccgacctgagagggtgatcggacacattgggactgagatacggcccaaactcctacgggatgcagcagctgagaatcttccgcaatggacgaaagtctgacggagcgacaccgcgtgaatgatgaaggccgaaaggttgtaaaattcttttgcagacaaagaataagtgtaggaggaaatgcctacatgatgacggtagttatgcgaataagccccggctaattacgtgcggggcgagcgttttcggaattattgggcgtaaagggcatgtaggcggtttaagcctgtgtgaatctacgagcttaactcgtaaatgcattgggtactgcttgaatcagaggggaactggaattccaagtgtaggggtggaatctgtagatatttggaagaacaccggtggcgaaggcgggtttctagcatgattgacgctatgcgaaggtgggggagcaaacaggattagataccctggtagtccgcacagtcatgtacactagtgggggtaagactcagtgggcaaacgcataagtgtaccgcctggggagtatgcccgcaaggtgaaactcaaaggaattgacgggggcccacacaagcggtggagcatgtggtttaattcgatgtacgcgaggaaccttacctgggtttgacataaggattatagagatatggtagcgtagatacgctttacaggtgctgcatggctgtcgtcagctcgtgccgtgaggtgttgggtaagtcccgcaacgagcgcaaccctactgccagttactaacaggtaaagtgaggactcggcggaactgccggtgataaaccggaggaaggtggggatgacgtcaagtcatcatggcccttatgtccagggctacacacgtgctacaatggttgttacaaagtgaagcgaagccgcgaggtgagcgaatgcaaaagcaatcgtagtcgattggaatctgaaacctgattcatgaagctggaatcgctagtaatcgctatcagcacgatgcggtgaatacgttcctgggccttgtacacaccgcccgtcacaccatccgagtcgaggtacccaagagctagtctaacgagggacggtggcgaaggtacgtggtaaggagggtgaagtcgtaac

SEQ ID NO: 1953 - DNA, 1456 bp, Treponema sp.
  oral taxon 265
aacgaacgctggcggcgcgtcttaagcatgcaagtcgaacggtaagaaggagcttgcttcttcctagagtggcggactggtgagtatcgcgtggatgacgtacccttttgacggggatagccgatagaaatatcagataataccggataatctcttttggggtaaagacgaaagaggaaagcagcttcggctgcgcaggaggaacggtccgcgtcctatcagctagtcggcagggtaaaggcctgccgaggcgacgacgggtatccggcctgagagggtggacggacacattgggactgagatacggcccagactcctacgggaggcagcagctaagaatattccgcaatggacgaaagtctgacggagcgacgccgcgtggacgatgaaggccggagggttgtaaagtccttttatccgtgaagaagaagcgtaagaggaaatgcttgcgtggtgacggtagcggatgaataagcaccggctaattacgtgccagcagccgcggtaacacgtaaggtgcgagcgttgttcggaattattgggcgtaaagggcatgcaggcggtcaggcaagcccggcgtgaaaggcgggggctcaactcccgaactgcgctgggaactgcagggcttgagtttctgaagggtagccggaattccacgtgtaggggtgaaatctgtagatatgtggaagaacaccaatggcgaaggcaggctactggcagaagactgacgctgaggtgcgaaggtgcggggagcaaacaggattagataccctggtagtccgcacagtcaacgatgtgcactagatgtctgtccacgaggatgggtgtcaaagcaaacgcgataagtgcaccgcctggggagtatgcccgcaagggtgaaactcaaaggaattgacgggggcccgcacaagcggtggagcatgtggtttaattcgatggtacgcgaggaaccttacctgggtttgacatacacagtgattatgtagagatatataagcgcagcaatgcgactgtgaacaggtgctgcatggctgtcgtcagctcgtgccgtgaggtgttgggttaagtcccgcaacgagcgcaacccctactgccagttaccagcatgtaatgatggggactctggcggaactgcctgcgacaagcaggaggaaggcggggatgacgtcaagtcatcatggcccttatgtccagggctacacacgtgctacaatggttgggacaaagcggagcgagtgcgagagtatgagcagaacgcagaaagccgatcgtagtccggattggagtctgaaactcgactccatgaagttggaatcgctagtaatcgcatatcagcacgatgcggtgaatacgttcccgggccttgtacacaccgcccgtcacaccatccgagtggagagtacccgaagccggcagtctaaccgcaagggggacgctgtcgaaggtatgcttcgtg

SEQ ID NO: 1954 - DNA, 1522 bp, Treponema sp.
  oral taxon 270
gagtttgatcctggctcagaacgaacgctggcggcgcgtcttaagcatgcaagtcgaatggcaagattggtgcttgcactgatcctagaatggcggactggtgagtaacgcgtgggtgacgtaccctttggacggggatagctgctagaaatagcagataataccggataaggtggcctgtgtcagaggcaggtcaggaaaggaacatttgttccgccgaaggaacggctcgcgagctattagctagttggtgaggtaacggcccaccaaggcgatgatagctacccggcctaagagggtgaacgggcacattgggactgagatacggcccagactcctacgggaggcagcagctaagaatattccgcaatggacgaaagtctgacggagcgacgccgcgtggatgatgaaggtcggaagattgtaaaatccttttatgactgaagaataagtatggtgagagaaacgccgtatggtgacagtaggtcatgaataagcaacggctaattacgtgccagcagccgcggtaacacgtaagttgcgagcgttgttcggaattattgggcgtaaagggcatgcaggcggaattgcaagcttggtgtgaaataccggggcttaactccggaatagcattgagaactgcaaaactagagtcactgaggggcaatcagaattccaggtgtaggggtgaaatctgtagatatctggaagaataccaatggcgaaggcaggttaccagcagatgactgacgctgaggtgcgaaggtgcggggagcaaacaggattagagaccctggtagtccgcacagtcaactatgtgcactagatgtctggtcgacagaccgggtgtcgaagcaaacgcgataagtgcaccgcctggggagtatgcccgcaagggtgaaactcaaaggaattgacgggggcccgcacaagcggtggagcatgtggtttaattcgatggtacgcgaggaaccttacctgggtttgacatacacaggaattatatagagatatgtaagcgcagcaatgcgcctgtgaacaggtgctgcatggctgtcgtcagctcgtgccgtgaggtgttgggttaagtcccgcaacgagcgcaacccctgctgccagttactaacacgtaaaggtgaggactctggcggaactgccggtgacaaaccggaggaaggcggggatgacgtcaagtcatcatggcccttatgtccagggctacacacgtgctacaatgggagatacagagtgaagcgaagcagcgatgcggagcaaaacgcagaaaacctctcgtagtccggattggagtctgaaactcgactccatgaagttggaatcgctagtaatcgcacatcagcacggtgcggtgaatacgttcccgggccttgtacacaccgcccgtcacaccatccgagtagattctacccgaagccggcagtctaaccgcaaggaggacgctgtcgaaggtaggatttgtgaggggggtgaagtcgtaacaaggtagtcgtaccggaaggtgcgg

SEQ ID NO: 1955 - DNA, 1475 bp, Treponema sp.
  oral taxon 271
aacgaacgctggcggcgcgtcttaagcatgcaagtcgaacggcaaggaagtgcttgcacttccctagagtggcggactggtgagtaacacgtgggtaacatgccttttagttggggatagctactagaaatagtagataataccgaatacgattttacagggtaaggctgtaaaaggaaaggagctacggctctgctgaaagattggctcgcggcccattagctagttggtgaggtaaatgcttaccaaggcaatgatgggtatccggcctgagagggtgaacggacacattgggactgagatacggcccagactcctacgggaggcagcagctaagaatgttccgcaatggagggaactctgacggagcgacgccgcgtggatgaagaaggtcgaaagattgtaaagttcttttgagatggaagaataagtattgcagggaatggcagtatggtgacagtacattttgaataagaggcggctaattacgtgccagcagccgcggtaacacgtaagcctcgagcgttgttcggaattattgggcgtaaagggcatgtaggcggtcataaaagcttggtgtgaaatctatgggcttaacccataaactgcgttgagaactgtatgacttgagttactgaagggaaactagaattccaggtgtaggggtggaatctgtagatatctggaagaataccaatggcgaaggcaagtttctggcagataactgacgctgaggtgcgaaggtgcggggagcaaacaggattagataccctggtagtccgcacagtaaactatgtacactaggtgtctgacataagtctgggtgccaaagcaaacgcgataagtgtaccgcctggggagtatgcccgcaagggtgaaactcaaaggaattgacgggggcccgcacaagcggtggagcatgtggtttaattcgatggtacgcgaggaaccttacctgggtttgacatagtacttaatagagtagagatactttagcgtagcaatacgaagtactacaggtgctgcatggctgtcgtcagctcgtgccgtgaggtgttgggttaagtcccgcaacgagcgcaacccctactgccagttactaacaggaaagctgaggactctggcggaactgccggtgacaaaccggaggaaggtggggatgacgtcaagtcatcatggcccttatgtccagggctacacacgtgctacaatggtagaaacagagtgaagcgaagcggcgacgtggagcaaaacgcaaaaaagctatcgtagttcggattggagtctgaaactcgactccatgaagttggaatcgctagtaatcgcacatcagcacggtgcggtgaatacgttcccgggccttgtacacaccgcccgtcacaccatccgagtagaggatacccgaagccggtagtctaaccgcaaggaggacgctgtcgaaggtatgctttgtaaggagggtgaagtcgtaacaa

SEQ ID NO: 1956 - DNA, 1381 bp, Treponema sp.
  oral taxon 508
aacgaacgctggcggtgcgtcttaagcatgcaagtcgaacggcaagaaagtgcttgcactttcctagagtggcggactggtgagtaacgcgtgggtgatctacctttaagatggggatagcttttagaaataagagataataccgaatgtgcttacggtgttttgacattgtaaggaaaggagcgtttgctccgcttaaagatgagcctgcgtcccattagctagttggtgaggtaaaggctcaccaaggcgatgatgggtatccggcctgagagggtgaccgacacattgggactgagatacggcccaaactcctacgggaggcagcagctgagaatcttccgcaatggacgaaagtctgacggagcgacaccgcgtgaatgatgaaggccgaaaggttgtaaaattcttttgcagacaaagaataaggatagtaggaaataactgtctgatgacggtagttacgcgaataagccccggctaattacgtgcggggcgagcgttttcggaattattgggcgtaaagggcatgtaggcggtttaagcctgtgtgaatctacgagcttaactcgtaaatgcattgggtactgcttgaatcagaggggaactggaattccaagtgtaggggtggaatctgtagatatttggaagaacaccggtggcgaaggcgggtttctagcatgattgacgctatgcgaaggtgggggagcaaacaggattagataccctggtagtccgcacagtcatgtacactagtgggggtaagactcagtgggcaaacgcataagtgtaccgcctggggagtatgcccgcaaggtgaaactcaaaggaattgacgggggcccacacaagcggtggagcatgtggtttaattcgatgtacgcgaggaaccttacctgggtttgacataaggattatagagatatggtagcgtagatacgctttacaggtgctgcatggctgtcgtcagctcgtgccgtgaggtgttgggtaagtcccgcaacgagcgcaaccctactgccagttactaacaggtaaagtgaggactcggcggaactgccggtgataaaccggaggaaggtggggatgacgtcaagtcatcatggcccttatgtccagggctacacacgtgctacaatggttgttacaaagtgaagcgaaccgcgaggtgagcgaatgcaaaagcaatcgtagtcgattggaatctgaaacctgattcatgaagctggaatcgctagtaatcgctatcagcacgatgcggtgaatacgttcctgggccttgtacacaccgcccgtcacaccatccgagtcgaggtacccaagagctagtctaacgagggacggtggcgaaggtacgtggtaaggagggtgaagtcgtaac

SEQ ID NO: 1957 - DNA, 1383 bp, Treponema sp.
  oral taxon 518
aacgaacgctggcggtgcgttttaagcatgcaagtcgaacggcaggaaggtgcttgcactttcctagagtggcggactggtgagtaacgcgtaggtgatctacctttaagactgggacagcctttagaaataaggggtaataccggatgtgcttattatgttttgacgtagtaagggaaggagcgtttgctccgcttagagatgagcctgcgtcccattagctagttggtaaggtaacggcctaccaaggcgatgatgggtatccgacctgagagggtgatcggacacattgggactgagatacggcccaaactcctacgggaggcagcagctgagaatcttccgcaatggacgaaagtctgacggagcgacaccgcgtgaatgatgaaggccgaaaggttgtaaagttcttttgcagacaaagaataaggatagaaggaaatgtctatttgatgacggtagttatgcgaataagccccggctaattacgtgcggggcgagcgttttcggaattattgggcgtaaagggcatgtaggcggtttaagcctgtgtgaatctacgagcttaactcgtaaatgcattgggtactgcttgaatcagaggggaactggaattccaagtgtaggggtggaatctgtagatatttggaagaacaccggtggcgaaggcgggtttctagcatgattgacgctatgcgaaggtgggggagcaaacaggattagataccctggtagtccgcacagtcatgtacactagtgggggtaagactcagtgggcaaacgcataagtgtaccgcctggggagtatgcccgcaaggtgaaactcaaaggaattgacgggggcccacacaagcggtggagcatgtggtttaattcgatgtacgcgaggaaccttacctgggtttgacataaggattatagagatatggtagcgtagatacgctttacaggtgctgcatggctgtcgtcagctcgtgccgtgaggtgttgggtaagtcccgcaacgagcgcaaccctactgccagttactaacaggtaaagtgaggactcggcggaactgccggtgataaaccggaggaaggtggggatgacgtcaagtcatcatggcccttatgtccagggctacacacgtgctacaatggttgttacaaagtgaagcgaagccgcgaggtgagcgaatgcaaaagcaatcgtagtcgattggaatctgaaacctgattcatgaagctggaatcgctagtaatcgctatcagcacgatgcggtgaatacgttcctgggccttgtacacaccgcccgtcacaccatccgagtcgaggtacccaagagctagtctaacgagggacggtggcgaaggtacgtggtaaggagggtgaagtcgtaac

SEQ ID NO: 1958 - DNA, 1405 bp, Treponema sp.
  oral taxon G85
aacgaacgctggcggcgcgtcttaagcatgcaagtcggacggcaagaaggggctcgccccttcctagagtggcggactggtgagtaacgcgtggacgacgcgcccacccgacggggacagccggtagaaataccggataataccggatgatctcttttggaataaaggcgaaagaggaaagcggctccggccgcgcgggtggagcggtccgcgtcctatcagctagtcggcggggtgaaggcctgccgaggcgacgacgggtatccggcctgagagggtggacggacacattgggactgagatacggcccagactcctacgggaggcagcagctaagaatattccgcaatggggggaaccccgacggagcgacgccgcgtggacgacgaaggccggaaggttgtaaagtccttttttccgcgaggaataaggccgggagggaatgcccggccggtgacggtagcggaggaataagcaccggctaattacgtgctaacacgtaaggtgcgagcgttgttcggaattattgggcgtaaagggcatgcaggcggtcgcaagcccggcgtgaaaggggggctaactcccatgcgctgggaactgaggcttgagtttctgaagggagcggaattccacgtgtaggggtgaaatctgtagatatgtggaagaacaccaatggcgaaggcaggtcggcgaagactgacgctgaggtgcgaaggtgcggggagcaaacaggattagatccctggtagtccgcacagtcaacgatgtgcactagatgtctgtccaaggatgggtgtcaaagcaaacgcgataagtgcaccgcctggggagtatgcccgcaagggtgaaactcaaaggaattgacgggggcccgcacaagcggtggagcatgtggtttaattcgatggtacgcgaggaaccttacctgggtttgacatacacagattattagagatattaagcgcagcaatgctctgtgacaggtgctgcatggctgtcgtcagctcgtgccgtgaggtgttgggttaagtcccgcaacgagcgcaacccctactgcagttaccagcgtagggggactctggcggaactgcctgcgacaagcaggaggaaggggggatgacgtcaagtcatcatggcccttatgtccagggcacacacgtgctacaatggttgggacaagcgagcgagtgcgagagtaagcagaacgcagaaaccgatcgtagtccggattggagtctgaaactcgactccatgaagttggaatcgctagtaatcgcaatcagcacgtgcggtgaatacgttcccgggccttgtacacaccgcccgtcacaccatccgagtgggggtacccgaagccggcagtctaaccgcaagggggacgctgtcgaaggtatgcttcgtgagg

SEQ ID NO: 1959 - DNA, 1543 bp, Treponema sp.
  ovine footrot
agagtttgatcatggctcagaacgaacgctggcggcgcgtcttaagcatgcaagtcgaacggcaagagaggagcttgcttctctcctagagtggcggactggtgaggaacacgtgggtaatctacccttaagatggggatagctgctagaaatagcaggtaataccgaatatactcagtgcttcataaggggtattgaggaaaggaagctacggcttcgcttgaggatgagcttgcgtcccattagctagttggtgaggtaaaggcccaccaaggcgacgatgggtatccggcctgagagggtgatcrgacacattgggactgagatacggcccaaactcctacgggaggcagcagctaagaatattccgcaatggacggaagtctgacggagcgacgccgcgtggatgaagaaggctgaaaagttgtaaaatccttttgttgatgaagaataagggtgagagggaatgctcatctgatgacggtaatcgacgaataagccccggctaattacgtgccagcagccgcggtaacacgtaaggggcgagcgttgttcggaattattgggcgtaaagggcatgtaggcggttatgtaagcctgatgtgaaatcctggggcttaaccccagaatagcattgggtactgtgtaacttgaattacggaagggaaactggaattccaagtgtaggggtggaatctgtagatatttggaagaacaccggtggcgaaggcgggtttctggccgataattgacgctgagatgcgaaagtgtggggatcgaacaggattagataccctggtagtccacaccgtaaacgatgtacactaggtgttggggcaagagcttcagtgccaaagcaaacgcgataagtgtaccgcctggggagtatgcccgcaagggtgaaactcaaaggaattgacgggggcccgcacaagcggtggagcatgtggtttaattcgatggtacgcgaggaaccttacctgggtttgacatctagtagaaggtcttagagataaggccgggtagcaataccctgctagacaggtgctgcatggctgtcgtcagctcgtgccgtgaggtgttgggttaagtcccgcaatgagcgcaacccctactgccagttactaacaggtaaagcttgaggactctggcggaactgccgatgacaaatcggaggaaggtggggatgacgtcaagtcatcatggcccttatgtccagggctacacacgtgctacaatggttgctacaaagcgaagcaagaccgtaaggtggagcaagccgcaaaaaagcaatcgtagttcggattgaagtctgaaactcgacttcatgaagttggaatcgctagtaatcgcgcatcagcacggcgcggtgaatacgttcccgggccttgtacacaccgcccgtcacaccatccgagttgggggtacccgaagtcgcttgtctaacctgcaaaggaggacggtgccgaaggtacgcttggtaaggagggtgaagtcgtaacaaggtagccgtaccggaaggtgcggctggatcacctcctta

SEQ ID NO: 1960 - DNA, 1548 bp, Treponema vincentii
tggagagtttgatcctggctcagaacgaacgctggcggcgcgtcttaagcatgcaagtcgaacggcaagagagaagcttgcttctctcctagagtggcggactggtgaggaacacgtgggtaatctacccttaagatggggatagctgctagaaatagcaggtaataccgaatagtctcaatggttcataagaagtattgaggaaaggaagctacggcttcgcttgaggatgagcttgcgtcccattagctagttggtgaggtaaaggcccaccaaggcgacgatgggtatccggcctgagagggtgatcggacacattgggactgagatacggcccaaactcctacgggaggcagcagctaagaatattccgcaatggacggaagtctgacggagcgacgccgcgtggatgaagaaggctgaaaagttgtaaaatccttttgttgatgaagaataagggtgagagggaatgctcatctgatgacggtaatcgacgaataagccccggctaattacgtgccagcagccgcggtaacacgtaaggggcgagcgttgttcggaattattgggcgtaaagggcatgtaggcggttatgtaagcctggtgtgaaatcctggggcttaaccctagaatagcattgggtactgtataacttgaattacggaagggaaactggaattccaagtgtaggggtggaatctgtagatatttggaagaacaccggtggcgaaggcgggtttctggccgataattgacgctgagatgcgaaagtgtggggatcgaacaggattagataccctggtagtccacactgtaaacgatgtacactaggtgttggggcaagagcttcagtgccaaagcaaacgcgataagtgtaccgcctggggagtatgcccgcaagggtgaaactcaaaggaattgacgggggcccgcacaagcggtggagcatgtggtttaattcgatggtacgcgaggaaccttacctgggtttgacatctagtagacagtcttagagataaggcttggtagcaataccctgctagacaggtgctgcatggctgtcgtcagctcgtgccgtgaggtgttgggttaagtcccgcaacgagcgcaacccctactgccagttactaacaggtaaagcttgaggactctggcggaactgccgatgacaaatcggaggaaggtggggatgacgtcaagtcatcatggcccttatgtccagggctacacacgtgctacaatggttgctacaaagcgaagcgagaccgtaaggtggagcaaaccgcaaaaaagcaatcgtagttcggattgaagtctgaaactcgacttcatgaagttggaatcgctagtaatcgcgcatcagcacggcgcggtgaatacgttcccgggccttgtacacaccgcccgtcacaccatccgagttgggggtacccgaagtcgcttgtctaacctgcaaaggaggacggtgccgaaggtacgcttggtgaggagggtgaagtcgtaacaaggtagccgtaccggaaggtgcggctggatcacctcctttct

SEQ ID NO: 1961 - DNA, 1530 bp, Tropheryma whipplei
ttattatggagagtttgatcctggctcaggacgaacgctggcggcgtgcttaacacatgcaagtcgaacggaaatcagggagcttgctccctgtgattagtggcgaacgggtgagtaacacgtgagcaacctgcccctaactttgggataacttcgggaaaccggggctaataccaaatacgacccatgagggcatcctctgtgggtggaaagaatttcggttggggatgggctcgcggcctatcagcttgttggtggggtaacggcctaccaaggcatcgacgggtagccggcctgagagggtgatcggccacactgggactgagacacggcccagactcctacgggaggcagcagtggggaatattgcacaatgggcgcaagcctgatgcagcaacgccgcgtgggggaagaaggccttcgggttgtaaacctcttttggcagggaagaagcgaaagtgacggtacctgcagaaaaagcgccggctaactacgtgccagcagccgcggtaatacgtagggcgcgagcgttgtccggaattattgggcgtaaagagctcgtaggcggtttgtcacgtctgccgtgaaaatccgaggctcaacctcggacctgcggtgggtacgggcaggctagagtgcgataggggagagcggaattcctggtgtagcggtgaaatgcgcagatatcaggaggaacaccgatggcgaaggcagctctctgggtcgctactgacgctgaggagcgaaagcgtggggagcgaacaggattagataccctggtagtccacgccgtaaacgttgggcgctagacgtgggggtggttccaccgcttccgtgtcgcagctaacgcattaagcgccccgcctggggagtacggccgcaaggctaaaactcaagggaattgacgggggcccgcacaagcggcggagcatgcggattaattcaatgcaacgcgaagaaccttaccaaggcttgatatataccggaaaggcgtagagatacgccccccgcaaggtcggtatacaggtggtgcacggttgtcgtcagctcgtgtcgtgagatgttgggttaagtcccgcaacgagcgcaaccctcgtcctgtgttgccagcgcgtaatggcggggactcacaggagactgccggggtcaactcggaggaaggtggggatgacgtcaaatcatcatgcccttcggtcttgggcttcacgcgtgctacaatggctggtacagagggttgcaatatcgcaaggtggagcgaatctcaaaaagccagtctcagttcggattggggtctgcaactcgaccccatgaagtcggagtcgctagtaatcgcagatcagcaatgctgcggtgaatacgttcccgggccttgtacacaccgcccgtcaagtcatgaaagctggtaacacccgaagccggtgacttaaccttttttggagagagccgtcgaaggtgggattggtgattgggactaagtcgtaacaaggtagccgtaccggaaggtgcggctggatcacctcctttctaagg

SEQ ID NO: 1962 - DNA, 1323 bp, Trueperella pyogenes
  modified_base (1119)..(1119): a, c, t, g, unknown or other
  modified_base (1119)..(1119): a, c, t, g, unknown or other
  modified_base (1154)..(1154): a, c, t, g, unknown or other
  modified_base (1154)..(1154): a, c, t, g, unknown or other
  modified_base (1237)..(1237): a, c, t, g, unknown or other
  modified_base (1237)..(1237): a, c, t, g, unknown or other
  modified_base (1276)..(1276): a, c, t, g, unknown or other
  modified_base (1276)..(1276): a, c, t, g, unknown or other
  modified_base (1279)..(1279): a, c, t, g, unknown or other
  modified_base (1279)..(1279): a, c, t, g, unknown or other
ggcgtgcttaacacatgcaagtcgaacgatgaagccggggctttttgttttggtggattagtggcgaacgggtgagtaatacgtgagtaacctgcccttgtctttgggataagcctgggaaactgggtctaataccggatattctgcttttgccgcatggtgggggttggaaagattttttggatggggatgggctcacggcctatcagcttgttggtggggtgatggcctaccaaggcgtcgacgggtagccggcctgagagggtgaccggccacattgggactgagatacggcccagactcctacgggaggcagcagtggggaatattgcacaatggacgcaagtctgatgcagcgacgccgcgtgggggatgaaggctttcgggttgtaaactcctttcagtacagaagaagcatttttgtgacggtatgtgcagaagaagcgccggctaactacgtgccagcagccgcggtaatacgtagggcgcgagcgttgtccggaattattgggcgtaaagagctcgtaggcggtttgttgcgcctgctgtgaaagaccggggcttaacttcggggttgcagtgggtacgggcagactagagtgtggtaggggtaattggaattcctggtgtagcggtggaatgcgcagatatcaggaggaacaccgatggcgaaggcaggttactgggccattactgacgctgaggagcgaaagcgtgggtagcgaacaggattagataccctggtagtccacgctgtaaacgttgggcactaggtgtggggccttttccacgggttctgcgccgtagctaacgctttaagtgccccgcctggggagtacggccgcaaggttaaaactcaaaggaattgacgggggcccgcacaagcggcggagcatgcggattaattcgatgcaacgcgaagaaccttaccaaggcttgacatacactgcgatgtgccagagatggtgcagccttcggggtggtgtacaggtggtgcatggttgtcgtcagctcgtgtcgtgagatgttgggttaagtcccgcaacgagcgcaacccttgtcctgtgttgccagcatgttgtggtggggactcacgggagactgccggggttaactcgnaggaaggtggggatgacgtcaaatcatcatgcccnttatgtcttgggcttcacgcatgctacaatggccggtacagagggttgcgagcctgtgagggtgagctaatcccttaaagctngtctcagttcggattggggtctgcaactcgaccccatgnagncggagtcgctagtaatcgcagatcagcaacgctgcggtgaatac

SEQ ID NO: 1963 - DNA, 1486 bp, Tsukamurella paurometabola
cctggctcaggacgaacgctggcggcgtgcttaacacatgcaagtcgaacggtaaggccctttcgggggtacacgagtggcgaacgggtgagtaacacgtgggtgacctgccctgtactttgggataagcctgggaaactgggtctaataccggatatgaccttctcctgcatgggggttggtggaaagcttttgcggtacaggatgggcccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggacgaagcgcaagtgacggtacctacagaagaagcaccggccaactacgtgccagcagccgcggtaatacgtagggtgcaagcgttgtccggaattactgggcgtaaagagctcgtaggcggtttgtcacgtcgtctgtgaaaacccgaggcttaacctcgggcctgcaggcgatacgggcagacttgagtactgtaggggagactggaattcctggtgtagcggtggaatgcgcagatatcaggaggaacaccggtggcgaaggcgggtctctgggcagtaactgacgctgaggagcgaaagcgtgggtagcgaacaggattagataccctggtagtccacgccgtaaacggtgggtactaggtgtgggtttccttccacgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatatacaccatcgccgcagagatgtggtttgccttgtgccttctatacaggtggtgcatggctgtcgtcagctcgtgtcgtgagatgttgggttaagtcccgcaacgagcgcaacccttgtctcatgttgccagcacgtaatggtggggactcgtgagagactgccggggtcaactcggaggaaggtggggatgacgtcaagtcatcatgccccttatgtccagggcttcacacatgctacaatggcgcgtacagagggctgcgataccgtgaggtggagcgaatcccttaaagcgcgtctcagttcggattggggtctgcaactcgaccccatgaagtcggagtcgctagtaatcgcagatcagcaacgctgcggtgaatacgttcccgggccttgtacacaccgcccgtcacgtcatgaaagtcggtaacacccgaagccggtggcctaacccttgtggagggagctgtcgaaggtgggattggcgattgggacgaagtcgtaacaaggtagccgtaccggaaggtgcgg

SEQ ID NO: 1964 - DNA, 1417 bp, Tsukamurella tyrosinosolvens
ggctcaggacgaacgctggcggcgtgcttaacacatgcaagtcgaacggtaaggccctttcgggggtacacgagtggcgaacgggtgagtaacacgtgggtgacctgccctgtacttcgggataagcctgggaaactgggtctaataccggatatgaccttctcctgcatgggggttggtggaaagtttttgcggtacaggatgggcccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagtagggacgaagcgcaagtgacggtacctacagaagaagcaccggccaactacgtgccagcagccgcggtaatacgtagggtgcgagcgttgtccggatttactgggcgtaaagagctcgtaggcggtttgtccgtcgtctgtgaaaacccgaggcttaacctcgggcctgcaggcgatacgggcagacttgagtactgtaggggagactggaattcctggtgtagcggtggaatgcgcagatatcaggaggaacaccggtggcgaaggcgggtctctgggcagtaactgacgctgaggagcgaaagcgtgggtagcgaacaggattagataccctggtagtccacgccgtaaacggtgggtactaggtgtgggtttccttccacgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatatagaggatcgccggagagattcggtttgccttgtgccttctatacaggtggtgcatggctgtcgtcagctcgtgtcgtgagatgttgggttaagtcccgcaacgagcgcaacccttgtctcatgttgccagcacgtaatggtggggactcgtgagagactgccggggtcaactcggaggaaggtggggatgacgtcaagtcatcatgccccttatgtccagggcttcacacatgctacaatggcgcgtacagagggctgcgataccgtgaggtggagcgaatcccttaaagcgcgtctcagttcggattggggtctgcaactcgaccccatgaagtcggagtcgctagtaatcgcagatcagcaacgctgcggtgaatacgttcccgggccttgtacacaccgcccgtcacgtcatgaaagtcggtaacacccgaagccggggcctaaccccttgtgggaggga

SEQ ID NO: 1965 - DNA, 1371 bp, Turicibacter sanguinis
  modified_base (50)..(50): a, c, t, g, unknown or other
  modified_base (50)..(50): a, c, t, g, unknown or other
tcgagcgaaccacttcggtggtgagcggcgaacgggtgagtaacacgtangttatctgcccatcagacggggacaacgattggaaacgatcgctaataccggataggacgaaagtttaaaggtgcttcggcaccactgatggatgagcctgcggcgcattagctagttggtagggtaaaggcctaccaaggcgacgatgcgtagccgacctgagagggtgaacggccacactgggactgagacacggcccagactcctacgggaggcagcagtagggaatcttcggcaatgggcgaaagcctgaccgagcaacgccgcgtgaatgatgaaggccttcgggttgtaaaattctgttataagggaagaatggctctagtaggaaatggctagagtgtgacggtaccttatgagaaagccacggctaactacgtgccagcagccgcggtaatacgtaggtggcgagcgttatccggaattattgggcgtaaagagcgcgcaggtggttgattaagtctgatgtgaaagcccacggcttaaccgtggagggtcattggaaactggtcaacttgagtgcagaagagggaagtggaattccatgtgtagcggtgaaatgcgtagagatatggaggaacaccagtggcgaaggcggcttcctggtctgtaactgacactgaggcgcgaaagcgtggggagcaaacaggattagataccctggtagtccacgccgtaaacgatgagtgctaagtgttgggggtcgaacctcagtgctgaagttaacgcattaagcactccgcctggggagtacggtcgcaagactgaaactcaaaggaattgacggggacccgcacaagcggtggagcatgtggtttaattcgaagcaacgcgaagaaccttaccaggtcttgacataccagtgaccgtcctagagataggattttcccttcggggacaatggatacaggtggtgcatggttgtcgtcagctcgtgtcgtgagatgttgggttaagtcccgcaacgagcgcaacccctgtcgttagttgccagcattcagttggggactctaacgagactgccagtgacaaactggaggaaggtggggatgacgtcaaatcatcatgccccttatgacctgggctacacacgtgctacaatggttggtacaaagagaagcgaagcggtgacgtggagcaaacctcataaagccaatctcagttcggattgtaggctgcaactcgcctacatgaagttggaatcgctagtaatcgcgaatcagcatgtcgcggtgaatacgttcccgggtcttgtacacaccgcccgtcacaccacgagagtttacaacacccgaagtcagtggcctaaccgcaaggagg

SEQ ID NO: 1966 - DNA, 1561 bp, Ureaplasma parvum
tgttctttgaaaactaaatagaatccgtcaattttaaagagtttgatcctggctcaggattaacgctggcggcatgcctaatacatgcaaatcgaacgaagccttttaggcttagtggtgaacgggtgagtaacacgtatccaatctacccttaagttggggataactagtcgaaagattagctaataccgaataataacatcaatatcgcatgagaagatgtagaaagtcgctctttgtggcgacgcttttggatgagggtgcgacgtatcagatagttggtgaggtaatggctcaccaagtcaatgacgcgtagctgtactgagaggtagaacagccacaatgggactgagacacggcccatactcctacgggaggcagcagtagggaatttttcacaatgggcgcaagccttatgaagcaatgccgcgtgaacgatgaaggtcttatagattgtaaagttcttttatatgggaagaaacgctaaaataggaaatgattttagtttgactgtaccatttgaataagtatcggctaactatgtgccagcagccgcggtaatacataggatgcaagcgttatccggatttactgggcgtaaaacgagcgcaggcgggtttgtaagtttggtattaaatctagatgcttaacgtctagctgtatcaaaaactgtaaacctagagtgtagtagggagttggggaactccatgtggagcggtaaaatgcgtagatatatggaagaacaccggtggcgaaggcgccaacttggactatcactgacgcttaggctcgaaagtgtggggagcaaataggattagataccctagtagtccacaccgtaaacgatcatcattaaatgtcggcccgaatgggtcggtgttgtagctaacgcattaaatgatgtgcctgggtagtacattcgcaagaatgaaactcaaacggaattgacggggacccgcacaagtggtggagcatgttgcttaatttgacaatacacgtagaaccttacctaggtttgacatctattgcgatgctatagaaatatagttgaggttaacaatatgacaggtggtgcatggttgtcgtcagctcgtgtcgtgagatgttgggttaagtcccgcaacgagcgcaacccctttcgttagttacttttctagcgatactgctaccgcaaggtagaggaaggtggggatgacgtcaaatcatcatgccccttatatctagggctgcaaacgtgctacaatggctaatacaaactgctgcaaaatcgtaagatgaagcgaaacagaaaaagttagtctcagttcggatagagggctgcaattcgtcctcttgaagttggaatcactagtaatcgcgaatcagacatgtcgcggtgaatacgttctcgggtcttgtacacaccgcccgtcaaactatgggagctggtaatatctaaaaccgcaaagctaaccttttggaggcatgcgtctagggtaggatcggtgactggagttaagtcgtaacaaggtatccctacgagaacgtggggatggatcacctcctttcttcggagtaaatt

SEQ ID NO: 1967 - DNA, 1517 bp, Ureaplasma urealyticum
caattttaaagagtttgatcctggctcaggattaacgctggcggcatgcctaatacatgcaaatcgaacgaagccttttaggcttagtggtgaacgggtgagtaacacgtatccaacctacccttaagttggggataactagtcgaaagattagctaataccgaataataacatcaatatcgcatgagaagatgtagaaagtcgcgtttgcgacgcttttggatgggggtgcgacgtatcagatagttggtgaggtaatggctcaccaagtcaatgacgcgtagctgtactgagaggtagaacagccacaatgggactgagacacggcccatactcctacgggaggcagcagtagggaatttttcacaatgggcgcaagccttatgaagcaatgccgcgtgaacgatgaaggtcttatagattgtaaagttcttttatatgggaagaaacgctaagataggaaatgattttagtttgactgtaccatttgaataagtatcggctaactatgtgccagcagccgcggtaatacataggatgcaagcgttatccggatttactgggcgtaaaacgagcgcaggcgggtttgtaagtttggtattaaatctagatgcttaacgtctagctgtatcaaaaactgtaaacctagagtgtagtagggagttggggaactccatgtggagcggtaaaatgcgtagatatatggaagaacaccggtggcgaaggcgccaacttggactatcactgacgcttaggctcgaaagtgtggggagcaaataggattagataccctagtagtccacaccgtaaacgatcatcattaaatgtcggctcgaacgagtcggtgttgtagctaacgcattaaatgatgtgcctgggtagtacattcgcaagaatgaaactcaaacggaattgacggggacccgcacaagtggtggagcatgttgcttaatttgacaatacacgtagaaccttacctaggtttgacatctattgcgacgctatagaaatatagttgaggttaacaatatgacaggtggtgcatggttgtcgtcagctcgtgtcgtgagatgttgggttaagtcccgcaacgagcgcaacccctttcgttagttgcttttctagcgatactgctaccgcaaggtagaggaaggtggggatgacgtcaaatcatcatgccccttatatctagggctgcaaacgtgctacaatggctaatacaaactgctgcaaaatcgtaagatgaagcgaaacagaaaaagttagtctcagttcggatagagggctgcaattcgccctcttgaagttggaatcactagtaatcgcgaatcagacatgtcgcggtgaatacgttctcgggtcttgtacacaccgcccgtcaaactatgggagctggtaatatctaaaaccgcaaagctaaccttttggaggcatgcgtctagggtaggatcggtgactggagttaagtcgtaacaaggtatccctacgagaacgtggggatggatcacctcctttct

SEQ ID NO: 1968 - DNA, 958 bp, Ureibacillus composti
  modified_base (15)..(15): a, c, t, g, unknown or other
  modified_base (15)..(15): a, c, t, g, unknown or other
  modified_base (90)..(90): a, c, t, g, unknown or other
  modified_base (90)..(90): a, c, t, g, unknown or other
  modified_base (97)..(97): a, c, t, g, unknown or other
  modified_base (97)..(97): a, c, t, g, unknown or other
  modified_base (170)..(170): a, c, t, g, unknown or other
  modified_base (170)..(170): a, c, t, g, unknown or other
acggctaactacgtnccagcagccgcggtaatacgtaggtggcaagcgttgtccggaattattgggcgtaaagcgcgcgcaggcggtctnttaagtntgatgtgaaagcccccggctcaaccggggagggtcattggaaactgggagacttgagtgcaggagagggaagnggaattccatgtgtagcggtgaaatgcgtagagatatggaggaacaccagtggcgaaggcggcttcctggcctgtaactgacgctgaggcgcgaaagcgtggggagcaaacaggattagataccctggtagtccacgccgtaaacgatgagtgctaggtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccgctgaccgccatggagacatggctttcccttcggggacagcggtgacaggtggtgcatggttgtcgtcagctcgtgtcgtgagatgttgggttaagtcccgcaacgagcgcaacccttgtccttagttgccatcattcagttgggcactctaaggagactgccgtacaaatacggaggaaggtggggatgacgtcaaatcatcatgccccttatgacctgggctacacacgtgctacaatgggtggtacaaagggcagcaaacccgcgagggggagcgaatcccaaaaagccactctcagttcggattgcaggctgcaactcgcctgcatgaagccggaatcgctagtaatcgcggatcagcatgccgcggtgaatacgttcccgggccttgtacacaccgcccgtcacaccacgagagtctgtaacacccgaagtcggtgaggtaaccctccgggagc

SEQ ID NO: 1969 - DNA, 1405 bp, Ureibacillus suwonensis
  modified_base (9)..(10): a, c, t, g, unknown or other
  modified_base (9)..(10): a, c, t, g, unknown or other
gcggaccannttagaaagcttgctttttagattggttagcggcggacgggtgagtaacacgtgggtaacctgccctatagaccgggataactcgcggaaacgcgtgctaataccggataacacaccgaagcgcatgcttcggggttgaaagatggttctgctatcactataggatgggcccgcggcgcattagctagttggtggggtaacggcctaccaaggcgacgatgcgtagccgacctgagagggtgatcggccacactgggactgagacacggcccagactcctacgggaggcagcagtagggaatcttccacaatgggcgaaagcctgatggagcaacgccgcgtgagcgaagaaggtcttcggatcgtaaagctctgttgtaagggaagaacaagcgcagcagtcactggctgcgccctgacggtaccttactagaaagccacggctaactacgtgccagcagccgcggtaatacgtaggtggcaagcgttgtccggaattattgggcgtaaagcgcgcgcaggcggtctcttaagtctgatgtgaaagcccccggctcaaccggggagggtcattggaaactgggagacttgagtgcaggagagggaagggaattccatgtgtagcggtgaaatgcgtagagatatggaggaacaccagtggcgaaggcggcttcctggcctgtaactgacgctgaggcgcgaaagcgtggggagcaaacaggattagataccctggtagtccacgccgtaaacgatgagtgctaggtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccgctgaccgccatggacacatggcgttcccatgggggacagcggtgacaggtggtgcatggttgtcgtcagctcgtgtcgtgagatgttgggttaagtcccgcaacgagcgcaacccttgtccttagttgccatcattcagttgggcactctaaggagactgccgtacaaatacggaggaaggtggggatgacgtcaaatcatcatgccccttatgacctgggctacacacgtgctacaatgggtggtacaaagggcagcaaacccgcgagggggagcgaatcccaaaaagccactctcagttcggattgcaggctgcaactcgcctgcatgaagccggaatcgctagtaatcgcggatcagcatgccgcggtgaatacgttcccgggccttgtacacaccgcccgtcacaccacgagagtctgtaacacccgaagtcggtgaggtaaccctccgggagc

SEQ ID NO: 1970 - DNA, 1489 bp, Ureibacillus terrenus
  modified_base (382)..(382): a, c, t, g, unknown or other
  modified_base (382)..(382): a, c, t, g, unknown or other
tggcggcgtgcctaatacatgcaagtcgagcggacctcataggaagcttgctttttatgaggttagcggcggacgggtgagtaacacgtgggtaacctgccctatagaccgggataactcgcggaaacgcgtgctaataccggataacacagcggagcgcatgctccggtgttgaaaggtggttctgctaccgctataggatgggcccgcggcgcattagctagttggtggggtaacggcctaccaaggcgacgatgcgtagccgacctgagagggtgatcggccacactgggactgagacacggcccagactcctacgggaggcagcagtagggaatcttccacaatgggcgaaagcctgatggagcaacgccgcgtgagngaagaaggtcttcggatcgtaaagctctgttgtaagggaagaacaagtgcggtagtaactgaccgcaccctgacggtaccttacgagaaagccacggctaactacgtgccagcagccgcggtaatacgtaggtggcgagcgttgtccggaattattgggcgtaaagcgcgcgcaggcggtctcttaagtctgatgtgaaagcccccggctcaaccggggagggtcattggaaactgggagacttgagtgcaggagagggaagcggaattccatgtgtagcggtgaaatgcgtagagatatggaggaacaccagtggcgaaggcggcttcctggcctgtaactgacgctgaagcgcgaaagcgtggggaccaaacaggattagataccctggtagtccacgccgtaaacgatgagtgctaagtgttagggggcttgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccgctgaccgccatggagacatggccttcccttcggggacagcggtgacaggtggtgcatggttgtcgtcagctcgtgtcgtgagatgttgggttaagtcccgcaacgagcgcaacccttgtccttagttgccatcattcagttgggcactctaaggagactgccgtacaaatacggaggaaggtggggatgacgtcaaatcatcatgccccttatgacctgggctacacacgtgctacaatgggcggtacaaagggctgcgaacccgcgagggggagcgaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagtctgtaacacccgaagtcggtgaggtaacccttccgggagccagccgccgaaggtgggacagatgattggggtgaagtcgtaacaaggtagccgtatc

SEQ ID NO: 1971 - DNA, 1402 bp, Ureibacillus thermophilus
  modified_base (30)..(30): a, c, t, g, unknown or other
  modified_base (30)..(30): a, c, t, g, unknown or other
  modified_base (1393)..(1393): a, c, t, g, unknown or other
  modified_base (1393)..(1393): a, c, t, g, unknown or other
cggaccaattaagaagcttgctttttgatntggttagcggcggacgggtgagtaacacgtgggtaacctgccctatagactgggataactcgcggaaacgtgagctaataccggataacacatcaaagtgcatgctttgatgttgaaagatggttctgctatcactataggatgggcccgcggcgcattagctagttggtggggtaacggcctaccaaggcgacgatgcgtagccgacctgagagggtgatcggccacactgggactgagacacggcccagactcctacgggaggcagcagtagggaatcttccacaatgggcgaaagcctgatggagcaacgccgcgtgagcgaagaaggtcttcggatcgtaaagctctgttgtaagggaagaacaagcgcagcagtaactggctgcgccctgacggtaccttactagaaagccacggctaatacgtgccagcagccgcggtaatagtaggtggcaagcgttgtccggaattattgggcgtaaagcgcgcgcaggcggtttcttaagtctgatgtgaaagcccccggctcaaccggggagggtcattggaaactgggagacttgagtgcaggagagggaagtggaattccatgtgtagcggtgaaatgcgtagagatatggaggaacaccagtggcgaaggcggcttcctggcctgtaactgacgctgaggcgcgaaagcgtggggagcaaacaggattagatacctggtagtccacgccgtaaacgatgagtgctaggtgttagggggtttccaccccttagtgctgcagctaacgcattaagcactccgcctggggagtacgtcgcaagactgaaactcaaaggaattgacgggggcccgcacaagcggtggagcatgtggtttaattcgaagcaacgcgaagaaccttaccaggtcttgacatcccgctgaccgccatggagacatggctttcccttcggggacagcggtgacaggtggtgcatggttgtcgtcagctcgtgtcgtgagatgttgggttaagtcccgcaacgagcgcaacccttgtccttagttgccatcattcagttgggcactctaaggagactgccgtacaaatacggaggaaggtggggatgacgtcaaatcatcatgccccttatgacctgggctacacacgtgctacaatgggcagtacaaagggctgcgaacccgcgagggggagcgaatcccaaaaagctgctctcagttcggattgcaggctgcaactcgcctgcatgaagccggaatcgctagtaatcgcagatcagcatgctgcggtgaatacgttcccgggccttgtacacaccgcccgtcacaccacgagagtctgtaacacccgaagtcggtggggtaaccctncgggagcca

SEQ ID NO: 1972 - DNA, 1540 bp, Ureibacillus thermosphaericus
tagagtttgatcatggctcaggacgaacgctggcggcgtgcctaatacatgcaagtcgagcgaaccaattgaaagcctagctttcatgaggttagcggcggacgggtgagtaacacgtgggtaacctgccctatagactgggataactcgcggaaacgcgtgctaataccggataacacatcaaagtgcatgctttgatgttgaaagatggttctgctatcactataggatgggcccgcggcgcattagcttgttggtggggtaacggcctaccaaggcgacgatgcgtagccgacctgagagggtgatcggccacactgggactgagacacggcccagactcctacgggaggcagcagtagggaatcttccacaatgggcgaaagcctgatggagcaacgccgcgtgagcgaagaaggtcttcggatcgtaaagctctgttgtaagggaagaacaagtgcagtagtaactggctgcaccttgacggtaccttactagaaagccacggctaactacgtgccagcagccgcggtaatacgtaggtggcaagcgttgtccggaattattgggcgtaaagcgcgcgcaggcggtctcttaagtctgatgtgaaagcccccggcttaaccggggagggtcattggaaactgggagacttgagtgcaggagagggaagcggaattccatgtgtagcggtgaaatgcgtagagatatggaggaacaccagtggcgaaggcggcttcctggcctgtaactgacgctgaggcgcgaaagcgtggggagcaaacaggattagataccctggtagtccacgccgtaaacgatgagtgctaagtgttagggggtttccaccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccgctgaccgctatggagacatagccttcccttcggggacagcggtgacaggtggtgcatggttgtcgtcagctcgtgtcgtgagatgttgggttaagtcccgcaacgagcgcaacccttgtccttagttgccatcattcagttgggcactctaaggagactgccgtacaaatacggaggaaggtggggatgacgtcaaatcatcatgccccttatgacctgggctacacacgtgctacaatggacggtacaaacggtcgcgaagtcgcgagacggagccaatccgaaaaaaccgttctcagttcggattgcaggctgcaactcgcctgcatgaagccggaatcgctagtaatcgcggatcagcatgccgcggtgaatacgttcccgggccttgtacacaccgcccgtcacaccacgagagtctgtaacacccgaagtcggtgaggtaaccctttcgggagccagccgccgaaggtgggacagatgattggggtgaagtcgtaacaaggtagccgtatcggaaggtgcggctggatcac

SEQ ID NO: 1973 - DNA, 1469 bp, Vagococcus fluvialis
acgaacgctggcggcgtgcctaatacatgcaagtcgaacgctttgattttcaccggagcttgctccaccgaaaatcaaagagtggcggacgggtgagtaacacgtgggcaacctgcccaacagagggggataacacttggaaacaggtgctaataccgcataatttgttttcccgcatgggagaataataaaagacgcttcggtgtcactgttggatgggcccgcgctgcattagttagttggtggggtaatggcctaccaagaccgtgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaagtgggagagtaactgttcccaccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagccctcggctcaaccgaggaaggtcattggaaactggggaacttgaatgcagaagaggagagtggaattccatgtgtagcggtgaaatgcgtagatatatggaggaacaccagtggcgaaggcgactctctggtctgtaattgacgctgaggctcgaaagcgtggggagcaaacaggattagataccctggtagtccacgccgtaaacgatgagtgctaagtgttggagggtttccgcccttcagtgctgcagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattgttagttgccatcattcagttgggcactctagcgagactgccggtgacaaaccggaggaaggtggggatgacgtcaaatcatcatgccccttatgacctgggctacacacgtgctacaatggacggtacaatgagtcgcgagaccgcgaggtttagctaatctcttaaagccgttctcagttcggattgtaggctgcaactcgcctacatgaagccggaatcgctagtaatcgtggatcagcacgccacggtgaatacgttcccgggccttgtacacaccgcccgtcacaccacgagagtttgtaacacccaaagtcggtgaggtaaccttttggagccagccgcctaaggtgggatagat

SEQ ID NO: 1974 - DNA, 1389 bp, Veillonella atypica
  modified_base (530)..(530): a, c, t, g, unknown or other
  modified_base (530)..(530): a, c, t, g, unknown or other
gcgatggaagcttgcttctatcaatcttagtggcgaacgggtgagtaacgcgtaatcaacctgcccttcagagggggacaacagttggaaacgactgctaataccgcatacgatccaatctcggcatcgagactggatgaaaggtggcctctatttataagctatcactgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaatggttcttgtgcgaatagtgcgaggatttgacggtaccggaatagaaagccacggctaactacgtgccagcagccgcggtaatagtaggtggcaagcgttgtccggaattattgggcgtaagcgcgcaggngagtctgtcttaaaagttcggggcttaaccccgtgatgggatggaaactgcgatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactagtgtagaggtatcgaccccttctgtgccggagttaacgcaataagtaccccgcctggggagtacgaccgcaaggttgaaactcaaaggaattgagggggcccgcacaagcggtggagtatgtggtttaattcgacgcaacgcgaagaacttaccaggtctgacattgatggacagaactagagatagttcttcttcttcggaagccagaaaacaggtggtgcacggttgtcgtcagctcgtgtcgtgagatgttgggttaagtcccgcaacgagcgcaacccctatcttatgttgccagcacttcgggtgggaactcatgagagactgccgcagacaatgcggaggaaggcggggatgacgtcaaatcatcatgccccttatgacctgggctacacacgtactacaatgggagttaatagacggaagcgaaaccgcgaggtggagcaaacccgagaaacactctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtgcccaaagccggtggggtaaccttcgggagc

SEQ ID NO: 1975 - DNA, 1005 bp, Veillonella dispar
  modified_base (820)..(820): a, c, t, g, unknown or other
  modified_base (820)..(820): a, c, t, g, unknown or other
  modified_base (855)..(855): a, c, t, g, unknown or other
  modified_base (855)..(855): a, c, t, g, unknown or other
  modified_base (938)..(938): a, c, t, g, unknown or other
  modified_base (938)..(938): a, c, t, g, unknown or other
  modified_base (992)..(992): a, c, t, g, unknown or other
  modified_base (992)..(992): a, c, t, g, unknown or other
tcgaacgaagagcgatggaagcttgcttctatcaatcttagtggcgaacgggtgagtaacgcgtaatcaacctgcccttcagagggggacaacagttggaaacgactgctaataccgcatacgatctaacctcggcatcgaggatggatgaaaggtggcctctatttataagctatcactgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaaaggccttcttgcgaatagttagaaggattgacggtaccggaatagaaagccacggctaactacgtgccagcagccgcggtaatacgtaggtggcaagcgttgtccggaattattgggcgtaaagcgcgcgcaggcggattggtcagtctgtcttaaaagttcggggcttaaccccgtgatgggatggaaactgccaatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccgganttaacgcaataagtaccccgcctggggagtacgancgcaaggttgaaactcaaaggaattgacgggggcccgcacaagcggtggagtatgtggtttaattcgacgcaacgcgaagaancttaccaggtcttgacattgatggacagaactagagatagttcctcttcttcgnaagccagaaaaca

SEQ ID NO: 1976 - DNA, 1296 bp, Veillonella sp.
  P1 oral clone MB5_P17
gacgaacgctggcggcgtgcttaacacatgcaagtcgaacgagtggcgaacgggtgagtaacgcgtaatcaacctgcccttcagagggggacaacagttggaaacgactgctaataccgcatacggaaagtcactgaaggaggggattgcgtctgattagctagttggaggggtaacggcccaccaaggcgatgatcagtagccggtctgagaggatgaacggccacattgggactgagacacggcccagactcctacgggaggcagcagttgggaatcttccgcaatggacgaaagtctgacggagcaacgccgcgtgagtgatgacggccttcgggttgtaaagctctgttaatcgggacgatgacggtaccggaatagaaagccacggctaactacgtgccagcagccgcggtaatacgtaggtggcaagcgttgtccggaattattgggcgtaaagcgcgcgcaggcggattggtcagtctgtcttaaaagttcggggcttaaccccgtgatgggatggaaactgccaatctagagtatcggagaggaaagtggaattcctagtgtagcggtgaaatgcgtagatattaggaagaacaccagtggcgaaggcgactttctggacgaactgacgctgaggcgcgaaagccaggggagcgaacgggattagataccccggtagtcctggccgtaaacgatgggtactaggtgtaggagcttctatgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattaacaggtggtgcacggttgtcgtcagctcgtgtcgtgagatgttgggttaagtcccgcaacgagcgcaacccctatcttatgttgccagcacgtgggaactcatgagagactgccgcagacaatgcggaggaaggcggggatgacgtcaaatcatcatgccccttatgacctgggctacacacgtactacaatgggagttagacggaagcgaaaccgcgaggtggagcagacccgagactctctcagttcggatgtaggctgcaactcgcctacggaagtcggaatcgctagtaatcgcaggtcagcatactgcggtgaatacgttcccgggccttgtacacaccgcccgtcacaccacgaaagtcggaagtgcccaaagccggtgggtagccagccgtctaaggtaaagtcgatgattggggtg

SEQ ID NO: 1977 - DNA, 1409 bp, Veillonella montpellierensis
gagcacgggagcttgctcctatgaatcttagtggcgaacgggtgagtaacgcgtaatcaacctgccctacaatgggggacaacagttggaaacgactgctaataccgcatacgacctacggttggcatcaatcgtaggtgaaaggtggcctctacatgtaagctatcgttgtaggaggggattgcgtctgattagctagttggaggggtaacggcccaccaaggcgatgatcagtagccggtctgagaggatgaacggccacattgggactgagacacggcccaaactcctacgggaggcagcagtggggaatcttccgcaatggacgaaagtctgacggagcaacgccgcgtgagtgatgacggtcttcggattgtaaagctctgttaatcgggacgaatggtttgtgtgcaaatagtgcatagacatgacggtaccggaatagaaagccacggctaactacgtgccagcagccgcggtaatacgtaggtggcaagcgttgtccggaattattgggcgtaaagcgcgcgcaggcggactagccagtcagtcttaaaagttcggggcttaaccccgtgatgggattgaaactactagtctagagtatcggagaggaaagtggaattcctagtgtagcggtgaaatgcgtagatattaggaagaacaccagtggcgaaggcgactttctggacgaacactgacgctgaggcgcgaaagccaggggagcgaacgggattagataccccggtagtcctggccgtaaacgatgggtactaagtgtgggaggtatcgaccccttccgtgctgcagttaacgcaataagtaccccgcctggggagtacggtcgcaagactgaaactcaaaggaattgacgggggcccgcacaagcggtggagtatgtggtttaattcgacgcaacgcgaagaaccttaccaggtcttgacattgatggacagaactagagatagtttttcttcttcggaagccagaaaacaggtggtgcacggttgtcgtcagctcgtgtcgtgagatgttgggttaagtcccgcaacgagcgcaacccctatcttatgttgccagcacgtaatggtgggaactcatgagagactgccgcagacaatgcggaggaaggcggggatgacgtcaaatcatcatgccccttatgacctgggctacacacgtactacaatgggagttaataaagagaagcgaaaccgcgaggtggagcgaacctcacaaacactctctcagttcggattgcaggctgcaactcgcctgcatgaagtcggaatcgctagtaatcgcaggtcagcatactgcggtgaatacgttcccgggccttgtacacaccgcccgtcacaccacgaaagtcggaagtacccaaagccggtggggtaaccttcgggagc

SEQ ID NO: 1978 - DNA, 1564 bp, Veillonella parvula
ttggagagtttgatcctggctcaggacgaacgctggcggcgtgcttaacacatgcaagtcgaacgaagagcgatggaagcttgcttctatcaatcttagtggcgaacgggtgagtaacgcgtaatcaacctgcccttcagagggggacaacagttggaaacgactgctaataccgcatacgatctaatctcggcatcgaggatagatgaaaggtggcctctacatgtaagctatcactgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaaaggccttcttgcgaatagtgagaaggattgacggtaccggaatagaaagccacggctaactacgtgccagcagccgcggtaatacgtaggtggcaagcgttgtccggaattattgggcgtaaagcgcgcgcaggcggatcaggtcagtctgtcttaaaagttcggggcttaaccccgtgatgggatggaaactgccaatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaaccagagatggttcctcttcttcggaagccagaaaacaggtggtgcacggttgtcgtcagctcgtgtcgtgagatgttgggttaagtcccgcaacgagcgcaacccctatcttatgttgccagcactttgggtggggaactcatgagagactgccgcagacaatgcggaggaaggcggggatgacgtcaaatcatcatgccccttatgacctgggctacacacgtactacaatgggagttaatagacggaagcgagatcgcgagatggagcaaacccgagaaacactctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtgcccaaagccggtggggtaaccttcgggagccagccgtctaaggtaaagtcgatgattggggtgaagtcgtaacaaggtagccgtatcggaaggtgcggctggatcacctcctttct

SEQ ID NO: 1979 - DNA, 1000 bp, Veillonella sp.
  3_1_44
  modified_base (992)..(994): a, c, t, g, unknown or other
  modified_base (992)..(994): a, c, t, g, unknown or other
tcgaacgaagagcgatggaagcttgcttctatcaatcttagtggcgaacgggtgagtaacgcgtaatcaacctgcccttcagagggggacaacagttggaaacgactgctaataccgcatacgatctaatctcggcatcgaggatagatgaaaggtggcctctacatgtaagctatcactgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaaaggccttcttgcgaatagtgagaaggattgacggtaccggaatagaaagccacggctaactacgtgccagcagccgcggtaatacgtaggtggcaagcgttgtccggaattattgggcgtaaagcgcgcgcaggcggataggtcagtctgtcttaaaagttcggggcttaaccccgtgatgggatggaaactgccaatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaacccttaccaggtcttgacattgatggacagaactagagatagttcctcttcttcnnnagccag

SEQ ID NO: 1980 - DNA, 1354 bp, Veillonella sp.
  6_1_27
agcgatggaagcttgcttctatcaatcttagtggcgaacgggtgagtaacgcgtaatcaacctgcccttcagagggggacaacagttggaaacgactgctaataccgcatacgatctaacctcggcatcgaggaaagatgaaaggtggcctctatttataagctatcactgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaaaggccttcttgcgaacagttagaaggattgacggtaccggaatagaaagccacggctaactacgtgccagcagccgcggtaatagtaggtggcaagcgttgtccggaattattgggcgtaaagcgcgcgcaggcggatcagtagtctgtttaaaagttcggggcttaaccccgtgatgggatggaaactgctgatctagagtatcggagaggaaagtggaattcctagtgtagcggtgaaatgcgtagatattaggaagaacaccagtggcgaaggcgactttctggacgaaaactgacgtgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaagatagggggcccgccaggggaggttatgaggaaactacaggttgacttcgcggtacagaaccagagatggttcttcttcttcggaagccagaaaacaggtggtgcacggttgtcgtcagctcgtgtcgtgagatgttgggttaagtcccgcaacgagcgcaacccctatcttatgttgccagcactttgggtgggaactcatgagagactgccgcagacaatgcggaggaaggcggggatgacgtcaaatcatcatgccccttatgacctgggctacacacgtactacaatgggagttaatagacggaagcgagatcgcgagatggagcaaacccgagaaacactctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtgcccaaagccggtggg

SEQ ID NO: 1981 - DNA, 1264 bp, Veillonella sp.
  ACP1
ggcggcgtgcttaacacatgcaagtcgaacgagtggcgaacgggtgagtaacgcgtaatcaacctgcccttcagagggggacaacagttggaaacgactgctaataccgcatacggaaagtcactgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgatgacggtaccggaatagaaagccacggctaactacgtgccagcagccgcggtaatacgtaggtggcaagcgttgtccggaattattgggcgtaaagcgcgcgcaggcggattggtcagtctgtcttaaaagttcggggcttaaccccgtgatgggatggaaactgccaatctagagtatcggagaggaaagtggaattcctagtgtagcggtgaaatgcgtagatattaggaagaacaccagtggcgaaggcgactttctggacgaactgacgctgaggcgcgaaagccaggggagcgaacgggattagataccccggtagtcctggccgtaaacgatgggtactaggtgtaggagcttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattaacaggtggtgcacggttgtcgtcagctcgtgtcgtgagatgttgggttaagtcccgcaacgagcgcaacccctatcttatgttgccagcacgtgggaactcatgagagactgccgcagacaatgcggaggaaggcggggatgacgtcaaatcatcatgccccttatgacctgggctacacacgtactacaatgggagttagacggaagcgaaaccgcgaggtggagcaaacccgagactctctcagttcggacgtaggctgcaactcgcctacggaagtcggaatcgctagtaatcgcaggtcagcatactgcggtgaatacgttcccgggccttgtacacaccgcccgtcacaccacgaaagtcggaagtgcccaaagccggtgggtagccagccgtctaa

SEQ ID NO: 1982 - DNA, 1209 bp, Veillonella sp.
  AS16
agtggcgaacgggtgagtaacgcgtaatcaacctgcccttcagagggggacaacagttggaaacgactgctaataccgcatacggaaagtcactgaaggaggggattgcgtctgatcagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgatgacggtaccggaatagaaagccacggctaactacgtgccagcagccgcggtaatacgtaggtggcaagcgttgtccggaattattgggcgtaaagcgcgcgcaggcggatcagtcagtctgtcttaaaagttcggggcttaaccccgtgaggggatggaaactgctgatctagagtatcggagaggaaagtggaattcctagtgtagcggtgaaatgcgtagatattaggaagaacaccagtggcgaaggcgactttctggacgaactgacgctgaggcgcgaaagccaggggagcgaacgggattagataccccggtagtcctggccgtaaacgatgggtactaggtgtaggagcttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattaacaggtggtgcacggttgtcgtcagctcgtgtcgtgagatgttgggttaagtcccgcaacgagcgcaacccttatcttatgttgccagcacgtggggactcatgagagactgccgcagacaatgcggaggaaggcggggatgacgtcaaatcatcatgccccttatgacctgggctacacacgtactacaatgggagttagacggaagcgaagccgcgaggtggagcgaacccgagactctctcagttcggacgtaggctgcaactcgcctacggaagtcggaatcgctagtaatcgcaggtcagcatactgcggtgaatacgttcccgggccttgtacacaccgcccgtcacaccacgaaagtcggaagtacccaaa

SEQ ID NO: 1983 - DNA, 844 bp, Veillonella sp.
  BS32b
  modified_base (45)..(45): a, c, t, g, unknown or other
  modified_base (45)..(45): a, c, t, g, unknown or other
  modified_base (50)..(50): a, c, t, g, unknown or other
  modified_base (50)..(50): a, c, t, g, unknown or other
  modified_base (656)..(656): a, c, t, g, unknown or other
  modified_base (656)..(656): a, c, t, g, unknown or other
  modified_base (663)..(663): a, c, t, g, unknown or other
  modified_base (663)..(663): a, c, t, g, unknown or other
  modified_base (713)..(713): a, c, t, g, unknown or other
  modified_base (713)..(713): a, c, t, g, unknown or other
  modified_base (782)..(782): a, c, t, g, unknown or other
  modified_base (782)..(782): a, c, t, g, unknown or other
  modified_base (788)..(788): a, c, t, g, unknown or other
  modified_base (788)..(788): a, c, t, g, unknown or other
  modified_base (815)..(816): a, c, t, g, unknown or other
  modified_base (815)..(816): a, c, t, g, unknown or other
cgaagagcgatggaagcttgcttctatcaatcttagtggcgaacnggagngtaacgcgtaatcaacctgcccttcagagggggacaacagttggaaacgactgctaataccgcatacgatccaatctcggcatcgagactggatgaaaggtggcctctatttataagctatcactgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaatggttcttgtgcgaatagtgcgaggatttgacggtaccggaatagaaagccacggctaactacgtgccagcagccgcggtaatacgtaggtggcaagcgttgtccggaattattgggcgtaaagcgcgcgcaggcggattggtcagtctgtcttaaaagttcggggcttaaccccgtgatgggatggaaactgccaatctagagtatcggagaggaaagtggaattcctagtgtagcggtgaaatgcgtanatattangaagaacaccagtggcgaaggcgactttctggacgaaaactgacgctgangcgcgaaagccaggggagcgaacgggattagataccccggtagtcctggccgtaaacgatgggtactangtgtangaggtatcgaccccttctgtgccgganntaacgcaataagtaccccgcctggggag

SEQ ID NO: 1984 - DNA, 1015 bp, Veillonella sp.
  ICM51a
  modified_base (709)..(709): a, c, t, g, unknown or other
  modified_base (709)..(709): a, c, t, g, unknown or other
  modified_base (979)..(979): a, c, t, g, unknown or other
  modified_base (979)..(979): a, c, t, g, unknown or other
  modified_base (996)..(998): a, c, t, g, unknown or other
  modified_base (996)..(998): a, c, t, g, unknown or other
  modified_base (1008)..(1008): a, c, t, g, unknown or other
  modified_base (1008)..(1008): a, c, t, g, unknown or other
gagcgatggaagcttgcttctatcaatcttagtggcgaacgggtgagtaacgcgtaatcaacctgcccttcagagggggacaacagttggaaacgactgctaataccgcatacgatccaatctcggcatcgagactggatgaaaggtggcctctatttataagctatcactgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaatggttcttgtgcaaatagtgcgaggatttgacggtaccggaatagaaagccacggctaactacgtgccagcagccgcggtaatacgtaggtggcaagcgttgtccggaattattgggcgtaaagcgcgcgcaggcggattggtcagtctgtcttaaaagttcggggcttaaccccgtgatgggatggaaactgccaatctagagtatcggagaggaaagtggaattcctagtgtagcggtgaaatgcgtagatattaggaagaacaccagtggcgaaggcgactttctggacgaaaactgacgctgangcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaactagagatagttcctcttcntcggaagccagaaaacnnnggtgcacggntgtcgtc

SEQ ID NO: 1985 - DNA, 971 bp, Veillonella sp.
  MSA12
  modified_base (591)..(591): a, c, t, g, unknown or other
  modified_base (591)..(591): a, c, t, g, unknown or other
  modified_base (703)..(703): a, c, t, g, unknown or other
  modified_base (703)..(703): a, c, t, g, unknown or other
  modified_base (772)..(772): a, c, t, g, unknown or other
  modified_base (772)..(772): a, c, t, g, unknown or other
  modified_base (869)..(869): a, c, t, g, unknown or other
  modified_base (869)..(869): a, c, t, g, unknown or other
tggaagcttgcttctatcaatcttagtggcgaacgggtgagtaacgcgtaatcaacctgcccttcagagggggacaacagttggaaacgactgctaataccgcatacgatctgacctcggcatcgaggatggatgaaaggtggcctctatttataagctatcactgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaaaggccttcttgcgaatagttagaaggattgacggtaccggaatagaaagccacggctaactacgtgccagcagccgcggtaatacgtaggtggcaagcgttgtccggaattattgggcgtaaagcgcgcgcaggcggattggtcagtctgtcttaaaagttcggggcttaaccccgtgatgggatggaaactgccnatctagagtatcggagaggaaagtggaattcctagtgtagcggtgaaatgcgtagatattaggaagaacaccagtggcgaaggcgactttctggacgaaaactgacgctgangcgcgaaagccaggggagcgaacgggattagataccccggtagtcctggccgtaaacgatgggtactangtgtaggaggtatcgaccccttctgtgccggagttaacgcaataagtaccccgcctggggagtacgaccgcaaggttgaaactcaaaggaattgacnggggcccgcacaagcggtggagtatgtggtttaattcgacgcaacgcgaagaaccttaccaggtcttgacattgatggacagaactagagatagttcctctt

SEQ ID NO: 1986 - DNA, 1344 bp, Veillonella sp.
  NVG 100cf
cgcgtaatcaacctgcccttcagagggggacaacagttggaaacgactgctaataccgcatacgatccaacctcggcatcgaggatggatgaaaggtggcctctatttataagctatcactgaaggaggggattgcgtctgattagctagttggaggggtaacggcccaccaaggcaatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaaaggtcctcttgcgaatagttagaggaattgacggtaccggaatagaaagccacggctaactacgtgccagcagccgcggtaatacgtaggtggcaagcgttgtccggaattattgggcgtaaagcgcgcgcaggcggatcagtcagtctgtcttaaaagttcggggcttaaccccgtgatgggatggaaactgctgatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaactagagatagttcctcttcttcggaagccagaaaacaggtggtgcacggttgtcgtcagctcgtgtcgtgagatgttgggttaagtcccgcaacgagcgcaacccctatcttatgttgccagcacgtaatggtgggaactcatgagagactgccgcagacaatgcggaggaaggcggggatgacgtcaaatcatcatgccccttatgacctgggctacacacgtactacaatgggagttaatagacggaagcgagatcgcgagatggagcaaacccgagaaacactctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtgcccaaagccggtgg

SEQ ID NO: 1987 - DNA, 1441 bp, Veillonella sp.
  OK11
  modified_base (9)..(9): a, c, t, g, unknown or other
  modified_base (9)..(9): a, c, t, g, unknown or other
  modified_base (150)..(150): a, c, t, g, unknown or other
  modified_base (150)..(150): a, c, t, g, unknown or other
tcgcgtctnccatgcagtcgaaacgaagagcgatggtaagcttgcttctatcaatcttagtggcgaacgggtgagtaacgcgtaatcaaccctgcccttcagagggggacaacagttggaaacgactgctaataccgcatacgatccaanctcggcatcgaggatggatgaaaggtggcctctatttataagctatcactgaaggaggggattgcgtctgattagctagttggaggggtaacggcccaccaaggcaatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaaaggtcttcttgcgaatagttagaagaattgacggtaccggaatagaaagccacggctaactacgtgccagcagccgcggtaatacgtaggtggcaagcgttgtccggaattattgggcgtaaagcgcgcgcaggcggatcagtcagtctgtcttaaaagttcggggcttaaccccgtgatgggatggaaactgctgatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaactagagatagttcctcttcttcggaagccagaaaacaggtggtgcacggttgtcgtcagctcgtgtcgtgagatgttgggttaagtcccgcaacgagcgcaacccctatcttatgttgccagcacgtaatggtgggaactcatgagagactgccgcagacaatgcggaggaaggcggggatgacgtcaaatcatcatgccccttatgacctgggctacacacgtactacaatgggagttaatagacggaagcgagatcgcgagatggagcaaacccgagaaacactctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtgcccaaagccggtggggtaaccttcggagccgc

SEQ ID NO: 1988 - DNA, 1364 bp, Veillonella sp.
  oral clone ASCA08
  modified_base (12)..(12): a, c, t, g, unknown or other
  modified_base (12)..(12): a, c, t, g, unknown or other
  modified_base (445)..(445): a, c, t, g, unknown or other
  modified_base (445)..(445): a, c, t, g, unknown or other
  modified_base (728)..(728): a, c, t, g, unknown or other
  modified_base (728)..(728): a, c, t, g, unknown or other
  modified_base (815)..(815): a, c, t, g, unknown or other
  modified_base (815)..(815): a, c, t, g, unknown or other
  modified_base (1340)..(1340): a, c, t, g, unknown or other
  modified_base (1340)..(1340): a, c, t, g, unknown or other
  modified_base (1344)..(1344): a, c, t, g, unknown or other
  modified_base (1344)..(1344): a, c, t, g, unknown or other
ggagtttgattntggctcaggacgaacgctggcggcgtgcttaacacatgcaagtcgaacgagtggcgaacgggtgagtaacgcgtaatcaacctgcccttcagagggggataacaacgggaaaccgttgctaataccgcgtacggaaagtcgctgaaggaggggattgcgtctgattagctagttggaggggtaacggcccaccaaggcaatgatcagtagccggtctgagaggatgaacggccacattgggactgagacacggcccaaactcctacgggaggcagcagtggggaatcttccgcaatggacgaaagtctgacggagcaacgccgcgtgagtgatgaaggtcttcggattgtaaagctctgttaatcgggacgatgacggtaccggaatagaaagccacggctaactacgtgccagcagccgcggtaatacgtangtggcaagcgttgtccgaaattattgggcgtaaagcgcgcgcagccggcctatccagtctgtcttaaaagttcggggctcaaccccgtgatgggatggaaactagtaggctagagtatcggagaggaaagcggaattcctagtgtagcggtgaaatgcgtagatattaggaagaacaccagtggcgaaggcggctttctggacgaactgacgctgaggcgcgaaagcaaggcgagcgaacgggattagataccccggtagtccttgccgtaaacgatgggtantaggtgtaggagcttctgtgccggagttaacgcaataataccccgcctggggagtacggtcgcaaggctgaaactcaaaggaattgncgggggcccgcacaagcggtggagtacgtggtttaattcgacgcaacgcgaagaaccttaccaggtcttgacattaacaggtggtgcacggctgtcgtcagctcgtgtcgtgagatgttgggttaagtcccgcaacgagcgcaacccctatcttatgttgccagcacgtgggaactcatgagagactgccgcagacaatgcggaggaaggaggggatgacgtcaagtcatcatgccccttatgacctgggctacacacgtactacaatgggctttagaggggagcgaagccgcgaggtggagcaaaccccagagctctcagttcggaagtaggctgcaactcgcctacggaagtcggaatcgctagtaatcacaggtcagcatactgcggtgaatacgttcccgggccttgtacacaccgcccgtcacacaacgaaagtcggaagtacccaaagccggtgggtagccagccgtctaaggtaaagtcgatgattggggtgaagtcgtaacaaggtagccgtatcgnaagntgcggctggaacacctcctt

SEQ ID NO: 1989 - DNA, 1323 bp, Veillonella sp.
  oral clone ASCB03
  modified_base (667)..(667): a, c, t, g, unknown or other
  modified_base (667)..(667): a, c, t, g, unknown or other
  modified_base (676)..(676): a, c, t, g, unknown or other
  modified_base (676)..(676): a, c, t, g, unknown or other
  modified_base (714)..(714): a, c, t, g, unknown or other
  modified_base (714)..(714): a, c, t, g, unknown or other
  modified_base (720)..(720): a, c, t, g, unknown or other
  modified_base (720)..(720): a, c, t, g, unknown or other
  modified_base (792)..(792): a, c, t, g, unknown or other
  modified_base (792)..(792): a, c, t, g, unknown or other
  modified_base (803)..(803): a, c, t, g, unknown or other
  modified_base (803)..(803): a, c, t, g, unknown or other
ggagtttgattctggctcaggacgaacgctggcggcgtgcttaacacatgcaagtcgaacgagtggcgaacgggtgagtaacgcgtaatcaacctgcccttcagagggggataacaacgggaaaccgttgctaataccgcgtacggaaagtcgctgaaggaggggattgcgtctgattagctagttggaggggtaacggcccaccaaggcaatgatcagtagccggtctgagaggatgaacggccacattgggactgagacacggcccaaactcctacgggaggcagcagtggggaatcttccgcaatggacgaaagtctgacggaacaacgccgcgtgagtgatgaaggtctgcggattgtaaagctctgttaatcgggacgatgacggtaccggaatagaaagccacggctaactacgtgccagcagccgcggtaatacgtaggtggcaagcgttgtccggaattattgggcgtaaagcgcgcgcaggcggcctatccagtctgtcttaaaagttcggggctcaaccccgtgatgggatggaaactactaggctagagtatcggagaggaaagcggaattcctagtgtagcggtgaaatgcgtagatattaggaagaacaccagtggcgaaggcggctttctggacgaactgacgctgaggcgcnaaagccagnggagcgaacgggattagataccccggtagtcctggccntaaacnatgggtactaggtgtaggagcttctgtgccggagttaacgcaataagtaccccgcctggggagtacggtcgnaaggctgaaantcaaaggaattgacgggggcccgcacaagcggtggagtatgtggtttaattcgacgcaacgcgaagaaccttaccaggtcttgacattaacaggtggtgcacggttgtcgtcagctcgtgtcgtgagatgttgggttaagtcccgcaacgagcgcaacccctatcttatgttgccagcacgtgggaactcatgagagactgccgcagacaatgcggaggaaggcggggatgacgtcaagtcatcatgccccttatgacctgggctacacacgtactacaatgggctttagagggaagcgaagccgcgaggtggagcaaaccccagagctctcagttcggacgtaggctgcaactcgcctacggaagtcggaatcgctagtaatcgcaggtcagcatactgcggtgaatacgttcccgggccttgtacacaccgcccgtcacaccacgaaagtcggaagtacccaaagccggtgggtagccagccgtctaaggtaaagtcgatgattggggtgaagtcgta

SEQ ID NO: 1990 - DNA, 1363 bp, Veillonella sp.
  oral clone ASCG01
  modified_base (360)..(360): a, c, t, g, unknown or other
  modified_base (360)..(360): a, c, t, g, unknown or other
ggagtttgattatggctcaggactaacgctggcggcgtgcttaacacatgcaagtcgaacgagtggcgaacgggtgagtaacgcgtaatcaacctgcccttcagagggggacaacagttggaaacgactgctaataccgcatacggaaagtcactgaaggaggggattgcgtctgattagctagttggaggggtaacggcccaccaaggcaatgatcagtagccggtctgagaggatgaacggccacattgggactgagacacggcccagactcctacgggaggcagcagtggggaatcttccgcaatggacgaaagtctgacggtgcaacgccgcgtgagtgatgacggccttcgggtngtaaagctctgttaatcgggacgatgacggtaccggaatagaaagccacggctaactacgtgccagcagccgcggtaatacgtaggtggcaagcgttgtccggaattattgggcgtaaagcgcgcgcaggcggatcagtcagtctgtcttaaaagttcggggcttaaccccgtgatgggatggaaactgctgatctagagtatcggagaggaaagtggaattcctagtgtagcggtgaaatgcgtagatattaggaagaacaccagtggcgaaggcgactttctggacgaactgacgctgaggcgcgaaagccaggggagcgaacgggattagataccccggtagtcctggccgtaaacgatgggtactaggtgtaggagcttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccgggtcttgacattaacaggtggtgcacggttgtcgtcagctcgtgtcgtgagatgttgggttaagtcccgcaacgagcgcaacccctatcttatgttgccagcacgtgggaactcatgagagactgccgcagacaatgcggaggaaggagaggatgacgtcaaatcatcatgccccttatgacctgggctacacacgtactacaatgggagttagacggaagcgagatcgcgagatggagcaaacccgagactctctcagttcggacgtaggctgcaactcgcctacggaagtcggaatcgctagtaatcgcaggtcagcatactgcggtgaatacgttcccgggccttgtacacaccgcccgtcacaccacgaaagtcggaagtgcccaaagccggtgggtagccagccgtctaaggtaaagtcgatgattggggtgaagtcgtaacaaggtagccgtatcggaaggtgcggctggaacacctc

SEQ ID NO: 1991 - DNA, 1296 bp, Veillonella sp.
  oral clone ASCG02
  modified_base (1102)..(1102): a, c, t, g, unknown or other
  modified_base (1102)..(1102): a, c, t, g, unknown or other
  modified_base (1143)..(1143): a, c, t, g, unknown or other
  modified_base (1143)..(1143): a, c, t, g, unknown or other
ggagtttgattctggctcaggacgaacgctggcggcgtgcttaacacatgcaagtcgaacgagtggcgaacgggtgagtaacgcgtaatcaacctgcccttcagagggggacaacagttggaaacgactgctaataccgcatacggaaagtcactgaaggaggggattgcgtctgattagctagttggaggggtaacggcccaccaaggcaatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgatgacggtaccggaatagaaagccacggctaactacgtgccagcagccgcggtaatacgtaggtggcaagcgttgtccggaattattgggcgtaaagcgcgcgcaggcggatcagttagtctgtcttaaaagttcggggcttaaccccgttgatgggatggaaactgctgatctagagtatcggagaggaaagtggaattcctagtgtagcggtgaaattcgtagatattaggaagaacaccagtggcgaaggcgactttctggacgaactgacgctgaggcgcgaaagccaggggagcgaacgggattagataccccggtagtcctggccgtaaacgatgggtactaggtgtaggagcttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacatcacaggtggtgcacggttgtcgtcagctcgtgtcgtgagatgttgggttaagtcccgcaacgagcgcaacccctatcttatgttgccagcacgtgggaactcatgagagactgccgcagacaatgcggaggaaggcggggatgacgtcaaatcatcatgccccttatgacctgggctactcacgtactacaatgggatagacggaagcganatcgcgagatggagcaaacccgagactctctcagttcggangtaggctgcaactcgcctacggaagtcggaatcgctagtaatcgcaggtcagcatactgcggtgaatacgttcccgggccttgtacacaccgcccgtcacaccacgaaagtcggaagtgcccaaagccggtgggtagccagccgtctaaggta

SEQ ID NO: 1992 - DNA, 1464 bp, Veillonella sp.
  oral clone OH1A
  modified_base (2)..(2): a, c, t, g, unknown or other
  modified_base (2)..(2): a, c, t, g, unknown or other
  modified_base (7)..(7): a, c, t, g, unknown or other
  modified_base (7)..(7): a, c, t, g, unknown or other
antcgancgaagagcgatggaagcttgcttctatcagtcttagtggcgaacgggtgagtaacgcgtaatcaacctgcccttcagagggggacaacagttggaaacgactgctaataccgcatacgatctaacctcggcattcaggatagatgaaaggtggcctctatttttaagctatcactgaaggaggggattgcgtctgatatgcgatagtgaggggggacggggccccccggcggatgaccagtgccggtttgagaggatgaacggccaccattggactgagacacggcccagactcctacgggaggcagcagtggggaatcttccgcaatggacgaaagtctgacggagcaacgccgcgtgagtgatgacggccttcgggtttaaagcttcgttaatcgggaagaaagggcctctgcgcgaacagtgagaaggattgacggtaccggaatagaaagccacggctaactacgtgccagcagccgcggtaatacgtaggtggcaagcgttgtccggaattattgggcgtaaagcgcgcgcaggcggatcagtcagtctgtcttaaaagttcggggcttaaccccgtgatgggatggaaactgctgatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgagtgaaagggcaagagattgtccccttatcttcggataacacgaaaacaggtggtgcatggttgtcgtcagctcgtgtcgtgagatgttgggttaagtcccgcaacgagcgcaacccctatcttatgttgccagcacttcgggtgggaactcatgagagactgccgcagacaatgcagaggaaggcggggatgacgtcaaatcatcatgccccttatgacctgggctacacacgtactacaatgggagttaatagacggaagcgagatcgcgagatggagcaaacccgagaaacactctttcagttcggatggtaggctgcaactcgcctacgtgaagtcggaatcgctagtaatcgcaggtcagcatactgcggtgaatacgttcccgggccttgtacacaccgcccgtcacaccacgaaagtcggaagtgcccaaagccggtggggtaaccttcgggagccagccgtctaaggtaaagtcgatgattggggaaaagtcgtaa

SEQ ID NO: 1993 - DNA, 976 bp, Veillonella sp.
  oral taxon 158
  modified_base (543)..(543): a, c, t, g, unknown or other
  modified_base (543)..(543): a, c, t, g, unknown or other
  modified_base (875)..(875): a, c, t, g, unknown or other
  modified_base (875)..(875): a, c, t, g, unknown or other
  modified_base (897)..(897): a, c, t, g, unknown or other
  modified_base (897)..(897): a, c, t, g, unknown or other
  modified_base (918)..(918): a, c, t, g, unknown or other
  modified_base (918)..(918): a, c, t, g, unknown or other
  modified_base (925)..(925): a, c, t, g, unknown or other
  modified_base (925)..(925): a, c, t, g, unknown or other
  modified_base (936)..(936): a, c, t, g, unknown or other
  modified_base (936)..(936): a, c, t, g, unknown or other
  modified_base (961)..(961): a, c, t, g, unknown or other
  modified_base (961)..(961): a, c, t, g, unknown or other
  modified_base (968)..(968): a, c, t, g, unknown or other
  modified_base (968)..(968): a, c, t, g, unknown or other
gagcgatggaagcttgcttctatcaatcttagtggcgaacgggtgagtaacgcgtaatcaacctgcccttcagagggggacaacagttggaaacgactgctaataccgcatacgatccaacctcggcatcgaggatggatgaaaggtggcctctatttataagctatcactgaaggaggggattgcgtctgattagctagttggaggggtaacggcccaccaaggcaatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaaaggtcctcttgcgaatagttagaggaattgacggtaccggaatagaaagccacggctaactacgtgccagcagccgcggtaatacgtaggtggcaagcgttgtccggaattattgggcgtaaagcgcgcgcaggcggatcanttagtctgtcttaaaagttcggggcttaaccccgtgatgggatggaaactgctgatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacnggggcccgcacaagcggtggantatgtggtttaattcgacgcnacgcgangaaccttaccnggtcttgacattgatggacagaacnagagatngttcctct

SEQ ID NO: 1994 - DNA, 1229 bp, Veillonellaceae bacterium oral taxon 131
gacgaacgctggcggcgtgcttaacacatgcaagtcgaacgagacggattgggagcttgctcctgacaagtcgagtggcaaacgggtgagtaacgcgtagacaacctgccgcaaagatggggacaacagcccgaaagggctgctaataccgaatgttgcgcccctcccgcatgggaggggcgccaaagatggcctctgcctgcaagccatcgctttgcgatgggtcctgcgccttattagccagttggcggggcaacggcccaccaaggcgacgatcagtagccggtcctgagaggatggacggccacattgggactgagacacggcccagactcctacgggaggcagcagtggggaatcttccgcaatgggcgaaagcctgacggagcaacgccgcgtgggtgaagaaggtcttcggatgcgtaaagccctgttgcccgggacgaacgcccccggcgcgaacagcgccggggggtgacggtaccgggcgaggaagccacggccaactacgtgccagcagccgcggtaatacgtaggtggcgagcgttgtccggaatcattgggcgtaaagggagcgcaggcgggcatgcaagtccatcttaaaagcgcggggcccaaccccgcgaggggatggaaactgcatgccttgagtgcaggagaggaaagcggaattcccagtgtagcggtgaaatgcgtagatattgggaggaacaccagtggcgaaggcggctttctggactgcaactgacgctgaggctcgaaagccaggggagcgaacgggattagataccccggtagtcctggccgtaaacgatgaatgctaggtgtggggggtatcgacccctcccgtgccggagtcaacgcaataagcattccgcctggggagtacggccgcaaggctgagactcaaaggaattgacgggggcccgcacaagcggtggagtatgtggttcaattcgacgcatggcgaaggaaccttaccagggccttgacattgagtgacacgggccggagacggcccccctcccctcgggggacacggaaaacagggtggtgcagtggctgtcgtcagcctcgttgtcgtgagatgtggggtcaagatcccgccaccgagcgccaccccccgttccctcgttggccagcgacgcacagggcggggaacccaagggaagaccgccgccggactacgccgaggaaggcgggggacgacgttcagttattcatgcccc

SEQ ID NO: 1995 - DNA, 1511 bp, Veillonellaceae bacterium oral taxon 155
gagtttgatcctggctcaggacgaacgctggcggcgtgcttaacacatgcaagtcgaacggagctgatttatttcggtaaatcgcttagtggcaaacgggtgagtaacgcgtaggcaacctgccctcaggatggggacaacggctcgaaagagccgctaataccgaatgacgtaactcttccacatggaagagatactaaagatgggtcaaaccatcgcctaaggatgggcctgcgtctgattagccagttggtgaggtaacggctcaccaaagcgacgatcagtagccggtctgagaggatgaacggccacaatgggactgagacacggcccatactcctacgggaggcagcagtggggaatcttccgcaatgggcgaaagcctgacggagcaacgccgcgtgagtgaagaaggtcttcggatcgtaaagctctgttgtcggggacgaaagagtagacgaggaaatgcgtctactaagacggtacccgacgaggaagccacggctaactacgtgccagcagccgcggtaatacgtaggcggcaagcgttgtccggaattattgggcgtaaagggagcgcaggtgggacggtaagtccgtcttaaaaggcaggggctcagcccctgtaagggatggaaactatcgatcttgagtgccggagaggaaagcggaattcccagtgtagcggtgaaatgcgtagatattgggaagaacaccagtggcgaaggcggctttctggacggcaactgacactgaggctcgaaagccaggggagcgaacgggattagataccccggtagtcctggccgtaaacgatggatactaggtgtaggaggtatcgacccctcctgtgccggagttaacgcaataagtatcccgcctggggagtacggtcgcaagactgaaactcaaaggaattgacgggggcccgcacaagcggtggagtatgtggtttaattcgacgcaacgcgaagaaccttaccagggcttgacattgagtgaaagggcaagagattgtccccttatcttcggataacacgaaaacaggtggtgcatggctgtcgtcagctcgtgtcgtgagatgttgggttaagtcccgcaacgagcgcaacccctatattctgttgccaacaggtaaagctgggaactcaggatagactgccgcggagaacgcggaggaaggcggggatgacgtcaagtcatcatgccccatatgacctgggctacacacgtactacaatgggatgtacagagggcagcgaaagagcgatctggagcgaaccccagaaaacatctcccagttcggattgcaggctgaaacccgcctgcatgaagatggaatcgctagtaatcgcaggtcagcatactgcggtgaatacgttcccgggccttgtacacaccgcccgtcacaccacggaagtcattcacacccgaagccggtgaaagccgtcgaaggtgggggcgatgactggggtgaagtcgtaacaaggtagccgtatcggaaggtgcgg

SEQ ID NO: 1996 - DNA, 1547 bp, Vibrio cholerae
tttaattgaagagtttgatcatggctcagattgaacgctggcggcaggcctaacacatgcaagtcgagcggcagcacagaggaacttgttccttgggtggcgagcggcggacgggtgagtaatgcctgggaaattgcccggtagagggggataaccattggaaacgatggctaataccgcataacctcgcaagagcaaagcaggggaccttcgggccttgcgctaccggatatgcccaggtgggattagctagttggtgaggtaagggctcaccaaggcgacgatccctagctggtctgagaggatgatcagccacactggaactgagacacggtccagactcctacgggaggcagcagtggggaatattgcacaatgggcgcaagcctgatgcagccatgccgcgtgtatgaagaaggccttcgggttgtaaagtactttcagtagggaggaaggtggttaagctaataccttaatyatttgacgttacctacagaagaagcaccggctaactccgtgccagcagccgcggtaatacggagggtgcaagcgttaatcggaattactgggcgtaaagcgcatgcaggtggtttgttaagtcagatgtgaaagccctgggctcaacctaggaatcgcatttgaaactgacaagctagagtactgtagaggggggtagaatttcaggtgtagcggtgaaatgcgtagagatctgaaggaataccggtggcgaaggcggccccctggacagatactgacactcagatgcgaaagcgtggggagcaaacaggattagataccctggtagtccacgccgtaaacgatgtctacttggaggttgtgmcctagaggtcgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaatctagcggagacgctggagtgccttcgggaactctgagacaggtgctgcatggctgtcgtcagctcgtgttgtgaaatgttgggttaagtcccgcaacgagcgcaacccttatccttgtttgccagcacgtaatggtgggaactccagggagactgccggtgataaaccggaggaaggtggggacgacgtcaagtcatcatggcccttacgagtagggctacacacgtgctacaatggcgtatacagagggcagcgataccgcgaggtggagcgaatctcacaaagtacgtcgtagtccggattggagtctgcaactcgactccatgaagtcggaatcgctagtaatcgcaaatcagaatgttgcggtgaatacgttcccgggccttgtacacaccgcccgtcacaccatgggagtgggctgcaaaagaagcaggtagtttaaccttcgggaggacgcttgccactttgtggttcatgactggggtgaagtcgtaacaaggtagcgctaggggaacctggcgctggatcacctccttac

SEQ ID NO: 1997 - DNA, 1537 bp, Vibrio fluvialis
  modified_base (11)..(12): a, c, t, g, unknown or other
  modified_base (11)..(12): a, c, t, g, unknown or other
agagtttgatnntggctcagattgaacgctggcggcaggcctaacacatgcaagtcgagcggcagcgacagagaaacttgtttctcgggcggcgagcggcggacgggtgagtaatgcctgggaaattgccctgatgtgggggataaccattggaaacgatggctaataccgcatgatagcttcggctcaaagagggggaccttcgggcctctcgcgtcaggatatgcccaggtgggattagctagttggtgaggtaagggctcaccaaggcgacgatccctagctggtctgagaggatgatcagccacactggaactgagacacggtccagactcctacgggaggcagcagtggggaatattgcacaatgggcgcaagcctgatgcagccatgccgcgtgtatgaagaaggccttcgggttgtaaagtactttcagcagtgaggaaggaggtatcgttaatagcggtatcttttgacgttagctgcagaagaagcaccggctaactccgtgccagcagccgcggtaatacggagggtgcgagcgttaatcggaattactgggcgtaaagcgcatgcaggtggtttgttaagtcagatgtgaaagcccggggctcaacctcggaattgcatttgaaactggcaggctagagtactgtagaggggggtagaatttcaggtgtagcggtgaaatgcgtagagatctgaaggaataccggtggcgaaggcggccccctggacagatactgacactcagatgcgaaagcgtggggagcaaacaggattagataccctggtagtccacgccgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatccttgtttgccagcgagtaatgtcgggaactccagggagactgccggtgataaaccggaggaaggtggggacgacgtcaagtcatcatggcccttacgagtagggctacacacgtgctacaatggcgcatacagagggcggccaacttgcgaaagtgagcgaatcccaaaaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggctgcaaaagaagcaggtagtttaaccttcgggaggacgcttgccactttgtggttcatgactggggtgaagtcgtaacaaggtagcgctaggggaacctggcgctggatcacctccttt

SEQ ID NO: 1998 - DNA, 1554 bp, Vibrio furnissii
taaattgaagagtttgatcatggctcagattgaacgctggcggcaggcctaacacatgcaagtcgagcggcagcgacaacattgaaccttcgggggatttgttgggcggcgagcggcggacgggtgagtaatgtctgggaaattgccctgatgtgggggataaccattggaaacgatggctaataccgcatgatagcttcggctcaaagagggggaccttcgggcctctcgcgtcaggatatgcccaggtgggattagctagttggtgaggtaagggctcaccaaggcgacgatccctagctggtctgagaggatgatcagccacactggaactgagacacggtccagactcctacgggaggcagcagtggggaatattgcacaatgggcgcaagcctgatgcagccatgccgcgtgtatgaagaaggccttcgggttgtaaagtactttcagcagtgaggaaggggatatcgttaatagcggtattctttgacgttagctgcagaagaagcaccggctaactccgtgccagcagccgcggtaatacggagggtgcgagcgttaatcggaattactgggcgtaaagcgcatgcaggtggtttgttaagtcagatgtgaaagcccggggctcaacctcggaattgcatttgaaactggcaggctagagtactgtagaggggggtagaatttcaggtgtagcggtgaaatgcgtagagatctgaaggaataccggtggcgaaggcggccccctggacagatactgacactcagatgcgaaagcgtggggagcaaacaggattagataccctggtagtccacgccgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatccttgtttgccagcgagtaatgtcgggaactccagggagactgccggtgataaaccggaggaaggtggggacgacgtcaagtcatcatggcccttacgagtagggctacacacgtgctacaatggcgcatacagagggcagccaacttgcgaaagtgagcgaatcccaaaaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggctgcaaaagaagcaggtagtttaaccttcgggaggacgcttgccactttgtggttcatgactggggtgaagtcgtaacaaggtagcgctaggggaacctggcgctggatcacctcctta

SEQ ID NO: 1999 - DNA, 1536 bp, Vibrio mimicus
agagtttgatcatggctcagattgaacgctggcggcaggcctaacacatgcaagtcgagcggcagcacagaggaacttgttccttgggtggcgagcggcggacgggtgagtaatgcctgggaaattgcccggtagagggggataaccattggaaacgatggctaataccgcataacctcgcaagagcaaagcaggggaccttcgggccttgtgctaccggatatgcccaggtgggattagctagttggtgaggtaagggctcaccaaggcgacgatccctagctggtctgagaggatgatcagccacactggaactgagacacggtccagactcctacgggaggcagcagtggggaatattgcacaatgggcgcaagcctgatgcagccatgccgcgtgtatgaagaaggccttcgggttgtaaagtactttcagtagggaggaaggtggttaagttaataccttaatcatttgacgttacctacagaagaagcaccggctaactccgtgccagcagccgcggtaatacggagggtgcaagcgttaatcggaattactgggcgtaaagcgcatgcaggtggtttgttaagtcagatgtgaaagccctgggctcaacctaggaattgcatttgaaactgacaagctagagtactgtagaggggggtagaatttcaggtgtagcggtgaaatgcgtagagatctgaaggaataccggtggcgaaggcggccccctggacagatactgacactcagatgcgaaagcgtggggagcaaacaggattagataccctggtagtccacgccgtaaacgatgtctacttggaggttgtgacctagagtcgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaatctagcggagacgctggagtgccttcgggaactctgagacaggtgctgcatggctgtcgtcagctcgtgttgtgaaatgttgggttaagtcccgcaacgagcgcaacccttatccttgtttgccagcacgtaatggtgggaactccagggagactgccggtgataaaccggaggaaggtggggacgacgtcaagtcatcatggcccttacgagtagggctacacacgtgctacaatggcgtatacagagggcagcgataccgcgaggtggagcgaatctcacaaagtacgtcgtagtccggattggagtctgcaactcgactccatgaagtcggaatcgctagtaatcgcaaatcagaatgttgcggtgaatacgttcccgggccttgtacacaccgcccgtcacaccatgggagtgggctgcaaaagaagcaggtagtttaaccttcgggaggacgcttgccactttgtggttcatgactggggtgaagtcgtaacaaggtagcgctaggggaacctggcgctggatcacctcctta

SEQ ID NO: 2000 - DNA, 1554 bp, Vibrio parahaemolyticus
taaattgaagagtttgatcatggctcagattgaacgctggcggcaggcctaacacatgcaagtcgagcggaaacgagttatctgaaccttcggggaacgatatcggcgtcgagcggcggacgggtgagtaatgcctaggaaattgccctgatgtgggggataaccattggaaacgatggctaataccgcatgatgcctacgggccaaagagggggaccttcgggcctctcgcgtcaggatatgcctaggtgggattagctagttggtgaggtaagggctcaccaaggcgacgatccctagctggtctgagaggatgatcagccacactggaactgagacacggtccagactcctacgggaggcagcagtggggaatattgcacaatgggcgcaagcctgatgcagccatgccgcgtgtgtgaagaaggccttcgggttgtaaagcactttcagtcgtgaggaaggtagtgtagttaatagctgcattatttgacgttagcgacagaagaagcaccggctaactccgtgccagcagccgcggtaatacggagggtgcgagcgttaatcggaattactgggcgtaaagcgcatgcaggtggtttgttaagtcagatgtgaaagcccggggctcaacctcggaattgcatttgaaactggcagactagagtactgtagaggggggtagaatttcaggtgtagcggtgaaatgcgtagagatctgaaggaataccggtggcgaaggcggccccctggacagatactgacactcagatgcgaaagcgtggggagcaaacaggattagataccctggtagtccacgccgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatccttgtttgccagcgagtaatgtcgggaactccagggagactgccggtgataaaccggaggaaggtggggacgacgtcaagtcatcatggcccttacgagtagggctacacacgtgctacaatggcgcatacagagggcggccaacttgcgaaagtgagcgaatcccaaaaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggctgcaaaagaagtaggtagtttaaccttcggggggacgcttaccactttgtggttcatgactggggtgaagtcgtaacaaggtagcgctaggggaacctggcgctggatcacctcctta

SEQ ID NO: 2001 - DNA, 1536 bp, Vibrio sp.
  RC341
agagtttgatcatggctcagattgaacgctggcggcaggcctaacacatgcaagtcgagcggcagcacagaggaacttgttccttgggtggcgagcggcggacgggtgagtaatgcctgggaaattgcccggtagagggggataaccattggaaacgatggctaataccgcataacctcgcaagagcaaagcaggggaccttcgggccttgcgctaccggatatgcccaggtgggattagctagttggtgaggtaagggctcaccaaggcgacgatccctagctggtctgagaggatgatcagccacactggaactgagacacggtccagactcctacgggaggcagcagtggggaatattgcacaatgggcgcaagcctgatgcagccatgccgcgtgtatgaagaaggccttcgggttgtaaagtactttcagtagggaggaaggtggttaagctaataccttaatcatttgacgttacctacagaagaagcaccggctaactccgtgccagcagccgcggtaatacggagggtgcaagcgttaatcggaattactgggcgtaaagcgcatgcaggtggtttgttaagtcagatgtgaaagccctgggctcaacctaggaatcgcatttgaaactgacaagctagagtactgtagaggggggtagaatttcaggtgtagcggtgaaatgcgtagagatctgaaggaataccggtggcgaaggcggccccctggacagatactgacactcagatgcgaaagcgtggggagcaaacaggattagataccctggtagtccacgccgtaaacgatgtctacttggaggttgtgacctagagtcgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaatctagcggagacgctggagtgccttcgggaactctgagacaggtgctgcatggctgtcgtcagctcgtgttgtgaaatgttgggttaagtcccgcaacgagcgcaacccttatccttgtttgccagcacgtaatggtgggaactccagggagactgccggtgataaaccggaggaaggtggggacgacgtcaagtcatcatggcccttacgagtagggctacacacgtgctacaatggcgtatacagagggcagcgataccgcgaggtggagcgaatctcacaaagtacgtcgtagtccggattggagtctgcaactcgactccatgaagtcggaatcgctagtaatcgcaaatcagaatgttgcggtgaatacgttcccgggccttgtacacaccgcccgtcacaccatgggagtgggctgcaaaagaagcaggtagtttaaccttcgggaggacgcttgccactttgtggttcatgactggggtgaagtcgtaacaaggtagcgctaggggaacctggcgctggatcacctcctta

SEQ ID NO: 2002 - DNA, 1542 bp, Vibrio vulnificus
aattgaagagtttgatcatggctcagattgaacgctggcggcaggcctaacacatgcaagtcgagcggcagcacagagaaacttgtttctcgggtggcaagcggcggacgggtgagtaatgcctgggaaattgccctgatgtgggggataaccattggaaacgatggctaataccgcatgatgcctacgggccaaagagggggaccttcgggcctctcgcgtcaggatatgcccaggtgggattagctagttggtgaggtaagggctcaccaaggcgacgatccctagctggtctgagaagatgatcagccacactggaactgagacacggtccagacttctacgggaggcagcagtggggaatattgcacaatgggcgcaagcctgatgcagccatgccgcgtgtgtgaagaaggccttcgggttgtaaagcactttcagttgtgaggaaggtggtgtcgttaatagcggcatcatttgacgttagcaacagaagaagcaccggctaactccgtgccagcagccgcggtaatacggagggtgcgagcgttaatcggaattactgggcgtaaagcgcatgcaggtggtttgttaagtcagatgtgaaagcccggggctcaacctcggaactgcatttgaaactggcagactagagtactgtagaggggggtagaatttcaggtgtagcggtgaaatgcgtagagatctgaaggaataccggtggcgaaggcggccccctggacagatactgacactcagatgcgaaagcgtggggagcaaacaggattagataccctggtagtccacgctgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaagccagcggagacgcaggtgtgccttcgggaactctgagacaggtgctgcatggctgtcgtcagctcgtgttgtgaaatgttgggttaagtcccgcaacgagcgcaacccttatccttgtttgccagcgagtaatgtcgggaactccagggagactgccggtgataaaccggaggaaggtggggacgacgtcaagtcatcatggcccttacgagtagggctacacacgtgctacaatggcgcatacagagggcggccaacttgcgaaagtgagcgaatcccaaaaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggctgcaaaagaagtgggtagtttaaccttcgggaggacgctcaccactttgtggttcatgactggggtgaagtcgtaacaaggtagcgctaggggaacctggcgctggatcacctcctta

SEQ ID NO: 2003 - DNA, 1467 bp, Victivallaceae bacterium NML 080035
tcagaacgaacgctggcggcatggattaggcatgcaagttgaacgaaccacttcggtggagagtagcggaagggtgaggaacgcgtgagtaatctgccccctagttgggaataacagttggaaacgactgctaataccgaatgtggcttcaatcctgcatgggatggaggctaaagatttatcgctaggggatgagctcgcgtcccattaggtagttggtgaggtaacggcccaccaagccgacgatgggtagctggtctgagaggatggtcagccacactgggactgagacactgcccagactcctacgggaggctgcagtcgagaatcttgggcaatgcgcgaaagcgtgacccagcaatgccgcgtgtgtgatgaaggccttcgggtcgtaaagcactgtctcccgtgacgaaatttgacggtagcggggaaggaagccacggctaactacgtgccagcagccgcggtaatacgtaggtggcgagcgttgttcggatttattgggcgtaaagggtctgtaggaggttcgttaaatacgaggtgaaatcccgaagctcaacttcggaactgccttgtagactgacggactagagtaccggagaggtaagcggaataccaggtgtagcggtggaatgcgtagatatctggtagaacaccaatagcgaaggcagcttgctggacggaaactgactctgaaagacgaaagcatggggagcaaacaggattagataccctggtagtccatgccgtaaacgttgtcaacttgatgtggggggatttagtcctctccgtatcgaagctaacgcgataagttgaccgcctggggactacggccgcaaggctaaaactcaaaggaattgacgggggcccgcacaagcggtggagcatgtggcttaattcgaggcaacgcgaagaaccttacctggtcttgaaatatatcggaccgcctgtgaaagcaggcttcccttcggggctgatatacaggtgctgcatggctgtcgtcagctcgtgccgtgaggtgttcggttaagtccggcaacgagcgcaacccgtgtcactagttgccatcaagtaatgttggggactctagtgagactgcctgtgttaagcaggaggaaggcgcggatgacgtcaagtcagtatggcccttacgaccagggctgcacacgtgctacaatggggggtacaatgggatgcaatgtcgcgaggcggagcaaatccacaaaacctctcttagttcagattgcagtctgcaactcgactgcatgaagttggaatcgctagtaaaggcgtatcagctacgacgccttgaatacgttcccgggccttgtacacaccgcccgtcacatcatgggagttgactgcacccgaaatcggtgatctaacctgcaaaggaagaagccgcctaaggtgtggtcgatgactgggatgaagtcgtaacaaggtagccgtaggggaacctgc

SEQ ID NO: 2004 - DNA, 1332 bp, Victivallis vadensis
cttcgggagtgagtagcgaaagggtgaggaacgcgtgagtaatctgcccataagttgggaacaacagttggaaacgactgctaataccgaatgtggctattgacccgcatgggtttttggctaaagatttatcgcttatggatgagctcgcgtcccattagctagttggtgaggtaacggcccaccaaggctacgatgggtagctggtctgagaggatggtcagccacactgggactgagacactgcccagactcctacgggaggctgcagtcgagaatcttgggcaatgcgcgaaagcgtgacccagcaatgccgcgtgcatgatgaaggccctcgggtcgtaaaatgctgtctcccgtgacgaataatgacggtagcggggaaggaagccacggctaactactgccagcagcgcggtaatacgtaggtggcgagcgttgttcggatttattgggcgtaaagggtctgtaggaggtttgttaaatacgaggtgaaatccgggggctcacttccgaattgccttgtagactgatgaactagagtactggagaggtaagcggaataccaggtgtagcggtggaatgcgtagatatctggtagaacaccaatagcgaaggcagcttgctggacagaaactgactctgaaagacgaaagcatggggagcaaacaggattagataccctggtagtccatgccgtaaacgttgtcaacttgatgtgggcggatttagtcctgtccgtatcgaagctaacgcgataagttgaccgcctgggaactacggccgcaaggctaaaactcaaaggaattgacgggggcccgcacaagcggtggagcatgtggcttaattcgaggcaacgcgaagaaccttacctgggcttgaaatataccggaccggctgtgaaagcagtcttctcttcggagctggtatacaggtgctgcatggctgtcgtcagctcgtgccgtgagttgctcggttaagtccggcaacgagcgcaacccgtgtcattagttgccaacaggtaatgctggggactctaatgagactgcctgtgttaagcaggaggaaggcgcggatgacgtcaagtcagtatggcccttacgcccagggctgcacacgtgctacaatggggggtacaatgagaagcgaagtcgcgaggcggagcaaatctacaaaacctctcttagttcagattgcagtctgcaactcgactgcatgaagttggaatcgctagtaaatgcgtatcagctacgacgcattgaatacgttcccgggccttgtacacaccgcccgtcacatcatgggagttgattgcacccgaaatcggtgatc

SEQ ID NO: 2005 - DNA, 1506 bp, Virgibacillus proomii
gcggcgtgcctaatacatgcaagtcgagcgcgggaagcaagcagaaccccttcgggggtgacgcatgtggaacgagcggcggacgggtgagtaacacgtgggcaacctgcctgtaagactgggataactccgggaaaccggggctaataccggataatacgttttcttgcataaggagacgttaaaaggcggcgcaagctgtcacttacagatgggcccgcggcgcattagctagttggtggggtaaaagcctaccaaggcgacgatgcgtagccgacctgagagggtgatcggccacactgggactgagacacrgcccagactcctacgggaggcagcagtagggaatcttccgcaatggacgaaagtctgacggagcaacgccgcgtgagtgaagaaggttttcggatcgtaaaactctgttgttagggaagaacaagtgccgttcaaatagggcggcaccttgacggtacctaaccagaaagccccggctaactacgtgccagcagccgcggtaatacgtagggggcaagcgttgtccggaattattgggcgtaaagcgcgcgcaggcggtcttttaagtctgatgtgaaagcccacggcttaaccgtggagggccattggaaactggaggacttgagtacagaagaggagagtggaattccacgtgtagcggtgaaatgcgtagagatgtggaggaacaccagtggcgaaggcgactctctggtctgtaactgacgctgaggtgcgaaagcgtgggtagcgaacaggattagataccctggtagtccacgccgtaaacgatgagtgctaggtgttagggggtttccgccccttagtgctgcagttaacgcattaagcactccgcctggggagtacggccgcaaggctgaaactcaaaagaattgacggggacccgcacaagcggtggagcatgtggtttaattcgaagcaacgcgaagaaccttaccaggtcttgacatcctctgacggccctagagatagggagttcccttcggggacagagtgacaggtggtgcatggttgtcgtcagctcgtgtcgtgagatgttgggttaagtcccgcaacragcgcaacccttgatcttarttgccagcattcagttgggcactctaaggtgactgccggtgacaaaccggaggaaggtggggatgacgtcaaatcatcatgccccttatgacctgggctacacacgtgctacaatggatggaacaaagggcagcgaagccgtgaggccaagcaaatcccacaaaaccattctcagttcggattgcaggctgcaactcgcctgcatgaagccggaatcgctagtaatcgcggatcagcatgccgcggtgaatacgttcccgggtcttgtacacaccgcccgtcacaccacgagagttggtaacacccgaagtcggtgaggtaaccgtaaggagccagccgccgaaggtgggaccaatgattggggtgaagtcgtaacaaggtasccgtatcggaagg

SEQ ID NO: 2006 - DNA, 1483 bp, Weissella beninensis
gcctggcggcgtgcctaatacatgcaagtcgaacgcattgtcgtggttatgatttgttaagcttgcttaacattgattaatcgccatacaatgagtggcgaacgggtgagtaacacgtgggaaacctacctcttagcaggggataacatttggaaacagatgctaataccgtataacaaataaaaccgcatggttttattttaaaagatggttctgctatcactaagagatggtcccgcggtgtattagctagatggtgaggtaatggctcaccatggcaatgatacatagccgagttgagagactgatcggccacattggaactgagacacggtccaaactcctacgggaggcagcagtagggaatcttccacaatgggcgcaagcctgatggagcaacgccgcgtgtgtgatgaagggtttcggctcgtaaaacactgttataagagaagaacgtcagtgagagtaactgttcattgagtgacggtatcttatcagaaagggacggctaaatacgtgccagcagccgcggtaatacgtatgtcccaagcgttatccggatttattgggcgtaaagcgagcgcaggcggttatttaagtctgatgtgaaagcctacggctcaaccgtagaattgcatcggaaactggatgacttgagtgcagtagaggagagtggaactccatgtgtagcggtgaaatgcgtagatatatggaagaacaccagaggcgaaggcggctctctggactgtaactgacgctgaggctcgaaagtgtgggtagcaaacaggattagataccctggtagtccacaccgtaaacgatgaatgctagttgttagagggtttccgccctttagtgacgcagctaacgcagtaagcattccgcctggggagtacgaccgcaaggttgaaactcaaaggaattgacgggggcccgcacaagcggtggagcatgtggtttaattcgaagcaacgcgaagaaccttaccaggtcttgacatctttcgctatcttaagagattaagagttcccttcggggacggaatgacaggtggtgcatggttgtcgtcagctcgtgtcgtgagatgttgggttaagtcccgcaacgagcgcaacccttattactagttgccagcatttagttgggcactctagtgagactgccggtgacaaaccggaggaaggtggggatgacgtcaaatcatcatgccccttatgacctgggctacacacgtgctacaatggatggtacaacgagtcgcaaagtcgcgaggctaagctaatctcttaaagccattctcagttcggattgtagtctgcaactcgactacatgaagtcggaatcgctagtaatcgcggatcagcacgccgcggtgaatacgttcccgggccttgtacacaccgcccgtcacaccatgagagtttgtaacacccaaagtcggtggggtaaccttttaggagccagccgcctaaggtgggataga

SEQ ID NO: 2007 - DNA, 1529 bp, Weissella cibaria
gatgaacgctggcggcgtgcctaatacatgcaagtcgaacgctttgtggttcaactgatttgaagagcttgctcagatatgacgatggacattgcaaagagtggcgaacgggtgagtaacacgtgggaaacctacctcttagcaggggataacatttggaaacagatgctaataccgtataacaatagcaaccgcatggttgctacttaaaagatggttctgctatcactaagagatggtcccgcggtgcattagttagttggtgaggtaatggctcaccaagacgatgatgcatagccgagttgagagactgatcggccacaatgggactgagacacggcccatactcctacgggaggcagcagtagggaatcttccacaatgggcgaaagcctgatggagcaacgccgcgtgtgtgatgaagggtttcggctcgtaaaacactgttgtaagagaagaatgacattgagagtaactgttcaatgtgtgacggtatcttaccagaaaggaacggctaaatacgtgccagcagccgcggtaatacgtatgttccaagcgttatccggatttattgggcgtaaagcgagcgcagacggttatttaagtctgaagtgaaagccctcagctcaactgaggaattgctttggaaactggatgacttgagtgcagtagaggaaagtggaactccatgtgtagcggtgaaatgcgtagatatatggaagaacaccagtggcgaaggcggctttctggactgtaactgacgttgaggctcgaaagtgtgggtagcaaacaggattagataccctggtagtccacaccgtaaacgatgagtgctaggtgtttgagggtttccgcccttaagtgccgcagctaacgcattaagcactccgcctggggagtacgaccgcaaggttgaaactcaaaggaattgacggggacccgcacaagcggtggagcatgtggtttaattcgaagcaacgcgaagaaccttaccaggtcttgacatcccttgacaactccagagatggagcgttcccttcggggacaaggtgacaggtggtgcatggttgtcrtcagctcgtgtcgtgagatgttgggttaagtcccgcaacragcgcaacccttattactagttgccagcattyagttgggcactctagtgagactgccggtgacaaaccggaggaaggtggggatgacgtcaaatcatcatgccccttatgacctgggctacacacgtgctacaatggcgtatacaacgagttgccaacccgcgagggtgagctaatctcttaaagtacgtctcagttcggattgtaggctgcaactcgcctacatgaagtcggaatcgctagtaatcgcggatcagcacgccgcggtgaatacgttcccgggtcttgtacacaccgcccgtcacaccatgagagtttgtaacacccaaagccggtggggtaaccttcgggagccagccgtctaaggtgggacagatgattagggtgaagtcgtaacaaggtagccgtaggagaacc

SEQ ID NO: 2008 - DNA, 992 bp, Weissella confusa
  modified_base (954)..(954): a, c, t, g, unknown or other
  modified_base (954)..(954): a, c, t, g, unknown or other
  modified_base (973)..(973): a, c, t, g, unknown or other
  modified_base (973)..(973): a, c, t, g, unknown or other
  modified_base (976)..(976): a, c, t, g, unknown or other
  modified_base (976)..(976): a, c, t, g, unknown or other
  modified_base (983)..(983): a, c, t, g, unknown or other
  modified_base (983)..(983): a, c, t, g, unknown or other
ggttcaactgatttgaagagcttgctcagatatgacgatggacattgcaaagagtggcgaacgggtgagtaacacgtgggaaacctacctcttagcaggggataacatttggaaacagatgctaataccgtataacaatgacaaccgcatggttgttatttaaaagatggttctgctatcactaagagatggtcccgcggtgcattagctagttggtaaggtaatggcttaccaaggcgatgatgcatagccgagttgagagactgatcggccacaatgggactgagacacggcccatactcctacgggaggcagcagtagggaatcttccacaatgggcgaaagcctgatggagcaacgccgcgtgtgtgatgaagggtttcggctcgtaaaacactgttgtaagagaagaatgacattgagagtaactgttcaatgtgtgacggtatcttaccagaaaggaacggctaaatacgtgccagcagccgcggtaatacgtatgttccaagcgttatccggatttattgggcgtaaagcgagcgcagacggttatttaagtctgaagtgaaagccctcagctcaactgaggaattgctttggaaactggatgacttgagtgcagtagaggaaagtggaactccatgtgtagcggtgaaatgcgtagatatatggaagaacaccagtggcgaaggcggctttctggactgtaactgacgttgaggctcgaaagtgtgggtagcaaacaggattagataccctggtagtccacaccgtaaacgatgagtgctaggtgtttgagggtttccgcccttaagtgccgcagctaacgcattaagcactccgcctggggagtacgaccgcaaggttgaaactcaaaggaattgacggggacccgcacaagcggtggagcatgtggtttaattcgaagcaacgcgaagaaccttaccaggtctngacatcccttgacactccnganatggagngttcccttc

SEQ ID NO: 2009 - DNA, 1496 bp, Weissella hellenica
gatgaacgctggcggcgtgcctaatacatgcaagtcgaacgctttgtgcttaattgatatgacgagcttgctctgatttgattttttgatttcaaagagtggcgaacgggtgagtaacacgtgggtaacctacctcttagcaggggataacatttggaaacaagtgctaataccgtataataccaacaaccgcatggttgttggttgaaagatggttctgctatcactaagagatggacccgcggtgcattagctagttggtaaggtaatggcttaccaaggcaatgatgcatagccgagttgagagactgatcggccacaatgggactgagacacggcccatactcctacgggaggcagcagtagggaatcttccacaatgggcgcaagcctgatggagcaacgccgcgtgtgtgatgaagggtttcggctcgtaaaacactgttataagagaagaacggcactgagagtaactgttcagtgtgtgacggtatcttaccagaaaggaacggctaaatacgtgccagcagccgcggtaatacgtatgttccaagcgttatccggatttattgggcgtaaagcgagcgcagacggttatttaagtctgaagtgaaagccctcagctcaactgaggaattgctttggaaactggatgacttgagtgcagtagaggaaagtggaactccatgtgtagcggtgaaatgcgtagatatatggaagaacaccagtggcgaaggcggctttctggactgtaactgacgttgaggctcgaaagtgtgggtagcaaacaggattagataccctggtagtccacaccgtaaacgatgagtgctagatgttcgagggtttccgcccttgagtgtcgcagctaacgcattaagcactccgcctggggagtacgaccgcaaggttgaaactcaaaggaattgacggggacccgcacaagcggtggagcatgtggtttaattcgaagcaacgcgaagaaccttaccaggtcttgacatcccttgacaacgctagaaatagcgcgttcccttcggggacaaggtgacaggtggtgcatggttgtcgtcagctcgtgtcgtgagatgttgggttaagtcccgcaacgagcgcaacccttattattagttgccagcattcagttgggcactctagtgagactgccggtgataaaccggaggaaggtggggatgacgtcaaatcatcatgccccttatgacctgggctacacacgtgctacaatggcatatacaacgagtcgctaacccgcgagggtacgctaatctcttaaagtatgtctcagttcggattgtaggctgcaactcgcctacatgaagtcggaatcgctagtaatcgcggatcagaacgccgcggtgaatacgttcccgggtcttgtacacaccgcccgtcacaccatgagagtttgtaacacccaaagccggtggggtaaccttttaggagccagccgtctaaggtgggacagatgattaggg

SEQ ID NO: 2010 - DNA, 1528 bp, Weissella kandleri
  modified_base (1)..(2): a, c, t, g, unknown or other
  modified_base (1)..(2): a, c, t, g, unknown or other
  modified_base (163)..(163): a, c, t, g, unknown or other
  modified_base (163)..(163): a, c, t, g, unknown or other
  modified_base (273)..(273): a, c, t, g, unknown or other
  modified_base (273)..(273): a, c, t, g, unknown or other
  modified_base (372)..(372): a, c, t, g, unknown or other
  modified_base (372)..(372): a, c, t, g, unknown or other
  modified_base (388)..(388): a, c, t, g, unknown or other
  modified_base (388)..(388): a, c, t, g, unknown or other
  modified_base (440)..(440): a, c, t, g, unknown or other
  modified_base (440)..(440): a, c, t, g, unknown or other
  modified_base (583)..(583): a, c, t, g, unknown or other
  modified_base (583)..(583): a, c, t, g, unknown or other
  modified_base (665)..(666): a, c, t, g, unknown or other
  modified_base (665)..(666): a, c, t, g, unknown or other
  modified_base (802)..(803): a, c, t, g, unknown or other
  modified_base (802)..(803): a, c, t, g, unknown or other
  modified_base (970)..(970): a, c, t, g, unknown or other
  modified_base (970)..(970): a, c, t, g, unknown or other
  modified_base (1005)..(1005): a, c, t, g, unknown or other
  modified_base (1005)..(1005): a, c, t, g, unknown or other
  modified_base (1060)..(1060): a, c, t, g, unknown or other
  modified_base (1060)..(1060): a, c, t, g, unknown or other
  modified_base (1090)..(1090): a, c, t, g, unknown or other
  modified_base (1090)..(1090): a, c, t, g, unknown or other
  modified_base (1137)..(1137): a, c, t, g, unknown or other
  modified_base (1137)..(1137): a, c, t, g, unknown or other
  modified_base (1425)..(1425): a, c, t, g, unknown or other
  modified_base (1425)..(1425): a, c, t, g, unknown or other
  modified_base (1524)..(1524): a, c, t, g, unknown or other
  modified_base (1524)..(1524): a, c, t, g, unknown or other
nntaaattgagagtttgatcctggctcaggatgaacgctggcggcgtgcctaatacatgcaagtcgaacgcactgtggttgaaatgagatgagaagcttgcttcaagtcaaatgccaacattgcagtgagtggcgaacgggtgagtaacacgtgggaaacctncctcttagcaggggataacatctggaaacaggtgctaataccgtataacaataaaaaccgcatggttttgatttaaaagatggttctgctatcactaagagatggtcccncggtgcattagttagttggtgaggtaaaggctcaccaagacgatgatgcatagccgagttgagagactgatcggccacaatgggactgagacacggccnatactcctacgggagncagcagtagggaatcttccacaatggacgaaagtctgatggagcaacgccgngtgtgtgatgaagggtttcggctcgtaaaacactgttgtaagagaagaatgacattgagagtaactgttcaatgtgtgacggtatcttaccagaaaggaacggctaaatacgtgccagcagccgcggtaatacgtatgttccnagcgttatccggatttattgggcgtaaagcgagcgcagacggttatttaagtctgaagtgaaagccctcggcttaaccgagnnattgctttggaaactggataacttgagtgcagtagaggaaagtggaactccatgtgtagcggtgaaatgcgtagatatatggaagaacaccagtggcgaaggcggctttctggactgtaactgacgttgaggctcnnaagtgtgggtagcaaacaggattagataccctggtagtccacaccgtaaacgatgagtgctagctgttcgagggtttccgcccttgagtggcgaagctaacgcattaagcactccgcctggggagtacgaccgcaaggttgaaactcaaaggaattgacggggaccngcacaagcggtggagcatgtggtttaattcgaagnaacgcgaagaaccttaccaggtcttgacatcctttgaccactccagagatggagntttcccttcggggtcaaagtgacaggtggngcatggttgtcgtcagctcgtgtcgtgagatgttgggttaagtcccncaacgagcgcaacccttattgttagttgccagcatttagttgggcactctagcaagactgccggtgacaaaccggaggaaggcggggatgacgtcaaatcatcatgccccttatgacctgggctacacacgtgctacaatggcaagtacaacgagcagccaacccgcgagggtgcgcaaatctcttaaagcttgtctcagttcggactgtaggctgcaactcgcctacacgaagtcggaatcgctagtaatcgcggatcagcacgccgcggtgaatacgttcccgggncttgtacacaccgcccgtcacaccatgagagtttgtaacacccaaagtcggtgaggtaacctttataggggccagccgcctaaggtgggacagatgatnaggg

SEQ ID NO: 2011 - DNA, 1591 bp, Weissella koreensis
tttaaattgagagtttgatcctggctcaggatgaacgctggcggcgtgcctaatacatgcaagtcgaacgcattgtggttgaaatgatatgaagaacttgttcagatttgattttcaacattgcaatgagtggcgaacgggtgagtaacacgtgggaaacctacctcttagcaggggataacatttggaaacaaatgctaataccgtataataattaaaaccgcatggttttagtttaaaagatggtcttgctatcactaagagatggtcccgcggtgtattagttagttggtgaggtaatggctcaccaagacaatgatacatagccgagttgagagactgaccggccacaatgggactgagacacggcccatactcctacgggaggcagcagtagggaatcttccacaatggacgaaagtctgatggagcaacgccgcgtgtgtgatgaagggtttcggctcgtaaaacactgttgtaagagaagaatgacattgagagtaactgttcaatgtgtgacggtatcttaccagaaaggaacggctaaatacgtgccagcagccgcggtaatacgtatgttccaagcgttatccggatttattgggcgtaaagcgagcgcagacggttatttaagtctgaagtgaaagccctcggctcaaccgaggaattgctttggaaactggataacttgagtgcagtagaggaaagtggaactccatgtgtagcggtgaaatgcgtagatatatggaagaacaccagtggcgaaggcggctttctggactgtaactgacgttgaggctcgaaagtgtgggtagcaaacaggattagataccctggtagtccacactgtaaacgatgagtgctagttgttcgagggtttccgcccttgagtgacgaagctaacgcattaagcactccgcctggggagtacgaccgcaaggttgaaactcaaaggaattgacggggacccgcacaagcggtggagcatgtggtttaattcgaagcaacgcgaagaaccttaccaggtcttgacatcctttgaccactccagagatggagctttcccttcggggacaaagtgacaggtggtgcatggttgtcgtcagctcgtgtcgtgagatgttgggttaagtcccgcaacgagcgcaacccttattgttagttgccagcatttagttgggcactctagcaagactgccggtgacaaaccggaggaaggcggggatgacgtcaaatcatcatgccccttatgacctgggctacacacgtgctacaatggcaagtacaacgagtcgccaacccgcgagggtgcgcaaatctcttaaagcttgtctcagttcggactgtaggctgcaactcgcctacacgaagtcggaatcgctagtaatcgcggatcagcacgccgcggtgaatacgttcccgggtcttgtacacaccgcccgtcacaccatgagagtttgtaacacccaaagtcggtgaggtaaccttttattaggagccagccgcctaaggtgggacagatgattagggtgaagtcgtaacaaggtagccgtaggagaacctgcggctggatcacctcctttctaaggaa

SEQ ID NO: 2012 - DNA, 1579 bp, Weissella paramesenteroides
tttaaaatgagagtttgatcctggctcaggatgaacgctggcggcgtgcctaatacatgcaagtcgaacgctttgtctttaactgatatgaagagcttgctctgatttgattttatctgacaaagagtggcgaacgggtgagtaacacgtgggtaacctacctcttagcaggggataacatttggaaacaagtgctaataccgtataataccaacaaccgcatggttgttggttgaaagatggttctgctatcactaagagatggacccgcggtgcattagctagttggtaaggtaacggcttaccaaggcaatgatgcatagccgagttgagagactgatcggccacaatgggactgagacacggcccatactcctacgggaggcagcagtagggaatcttccacaatgggcgcaagcctgatggagcaacgccgcgtgtgtgatgaagggtttcggctcgtaaaacactgttataagagaagaacggcactgagagtaactgttcagtgtgtgacggtatcttaccagaaaggaacggctaaatacgtgccagcagccgcggtaatacgtatgttccaagcgttatccggatttattgggcgtaaagcgagcgcagacggttatttaagtctgaagtgaaagccctcagctcaactgaggaatggctttggaaactggatgacttgagtgcagtagaggaaagtggaactccatgtgtagcggtgaaatgcgtagatatatggaagaacaccagtggcgaaggcggctttctggactgtaactgacgttgaggctcgaaagtgtgggtagcaaacaggattagataccctggtagtccacaccgtaaacgatgagtgctagatgttcgagggtttccgcccttgagtgtcgcagctaacgcattaagcactccgcctggggagtacgaccgcaaggttgaaactcaaaggaattgacggggacccgcacaagcggtggagcatgtggtttaattcgaagcaacgcgaagaaccttaccaggtcttgacatcccttgctaatcctagaaataggacgttcccttcggggacaaggtgacaggtggtgcatggttgtcgtcagctcgtgtcgtgagatgttgggttaagtcccgcaacgagcgcaacccttattattagttgccagcattcagttgggcactctagtgagactgccggtgacaaaccggaggaaggtggggatgacgtcaaatcatcatgccccttatgacctgggctacacacgtgctacaatggcatatacaacgagtcgccaacccgcgagggtgcgctaatctcttaaagtatgtctcagttcggattgtaggctgcaactcgcctacatgaagtcggaatcgctagtaatcgcggatcagcacgccgcggtgaatacgttcccgggtcttgtacacaccgcccgtcacaccatgagagtttgtaacacccaaagccggtggggtaaccttttaggagccagccgtctaaggtgggacagatgattagggtgaagtcgtaacaaggtagccgtaggagaacctgcggctggatcacctcctttct

SEQ ID NO: 2013 - DNA, 1234 bp, Weissella sp.
  KLDS 7.0701
agtggcgaacgggtgagtaacacgtgggaaacctacctcttagcaggggataacatttggaaacagatgctaataccgtataacaaaagtcactaagagatggtcccgcggtgcattagttagttggtgaggtaatggctcaccaagacgatgatgcatagccgagttgagagactgatcggccacaatgggactgagacacggcccatactcctacgggaggcagcagtagggaatcttccacaatgggcgaaagcctgatggagcaacgccgcgtgtgtgatgaagggtttcggctcgtaaaacactgttgtaagagaagatgacggtatcttaccagaaaggaacggctaaatacgtgccagcagccgcggtaatacgtatgttccaagcgttatccggatttattgggcgtaaagcgagcgcagacggttatttaagtctgaagtgaaagccctcagctcaactgaggaattgctttggaaactggatgacttgagtgcagtagaggaaagtggaactccatgtgtagcggtgaaatgcgtagatatatggaagaacaccagtggcgaaggcggctttctggactgactgacgttgaggctcgaaagtgtgggtagcaaacaggattagataccctggtagtccacaccgtaaacgatgagtgctaggtgtttgagcttaagtgccgcagctaacgcattaagcactccgcctggggagtacgaccgcaaggttgaaactcaaaggaattgacggggacccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccttattactagttgccagcatgggcactctagtgagactgccggtgacaaaccggaggaaggtggggatgacgtcaaatcatcatgccccttatgacctgggctacacacgtgctacaatggcgtacaacgagttgccaacccgcgagggtgagctaatctctttacgtctcagttcggatgtaggctgcaactcgcctacagaagtcggaatcgctagtaatcgcggatcagcacgccgcggtgaatacgttcccgggtcttgtacacaccgcccgtcacaccatgagagtttgtaacacccaaagccggtgggtagccagccgtctaagg

SEQ ID NO: 2014 - DNA, 1480 bp, Wolinella succinogenes
agagtttgatcctggctcagagtgaacgctggcggcgtgcctaatacatgcaagtcgaacggtaacagggtgtagcttgctatactgctgacgagtggcgcacgggtgagtaatgcataggttatgtgccccatagtctggaatagccactggaaacggtgattaataccggatattcccgagaggggaaagtttttcgctatgggatcagcctatgtcctatcagcttgttggtgaggtaatggctcaccaaggctatgacgggtatccggcctgagagggtgatcggacacactggaactgagacacggtccagactcctacgggaggcagcagtagggaatattgctcaatgggcgaaagcctgaagcagcaacgccgcgtggaggatgaaggtcttcggattgtaaactccttttctaagagaagattatgacggtatcttaggaataagcaccggctaactccgtgccagcagccgcggtaatacggagggtgcaagcgttactcggaatcactgggcgtaaagagcacgtaggcggccttgcaagtcagatgtgaaatccaacggcttaaccgttgaactgcatttgaaactgcaaggctagagtatgggagaggtaggtggaattctcggtgtaggggtaaaatccgtagagatcgagaggaatactcattgcgaaggcgacctgctggaacattactgacgctgaggtgcgaaagcgtggggagcaaacaggattagataccctggtagtccacgccctaaacgatgaatgctagttgttgccctgcttgtcagggcagtaatgcagttaacacattaagcattccgcctggggagtacggtcgcaagattaaaactcaaaggaatagacggggacccgcacaagcggtggagcatgtggtttaattcgaagatacgcgaagaaccttacctgggcttgacattgatagaatcctatagagatatgggagtgccagtttactggagcttgaaaacaggtgctgcacggctgtcgtcagctcgtgtcgtgagatgttgggttaagtcccgcaacgagcgcaaccctcgtcactagttgctaacggttcggccgagcactctagtgagactgccttcgcaaggaggaggaaggtgaggacgacgtcaagtcatcatggcccttacgcccagggctacacacgtgctacaatggtgtgtacaaagagaagcaataccgcgaggtggagcaaatctttaaaacacatctcagttcggattgtagtctgcaactcgactacatgaagctggaatcgctagtaatcgtagatcagcaatgctacggtgaatacgttcccgggtcttgtactcaccgcccgtcacaccatgggagttgtattcgccttaagccgggacgctaaactggctaccgtccacggcggatgcagcgactggggtgaagtcgtaacaaggtaaccgtaggtgaacctgcggttg

SEQ ID NO: 2015 - DNA, 1491 bp, Xanthomonadaceae bacterium NML 03-0222
agtgaacgctggcggcaggcctaacacatgcaagtcgaacggcagcgcgagagagcttgctctcttggcggcgagtggcggacgggtgaggaatacgtcggaatctgcctatttgtgggggataacgtagggaaacttacgctaataccgcatacgtcctacgggagaaagcaggggaccttcgggccttgcgcagatagatgagccgacgtcggattagctagttgggggggtaatggcccaccaaggcaacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcatgcggttaatacccgtgtgtcatgacggtacccaaagaataagcaccggctaacttcgtgccagcagccgcggtaatacgaagggtgcaagcgttactcggaattactgggcgtaaagcgtgcgtaggtggtttgttaagtcagatgtgaaagccctgggctcaacctgggaactgcatttgatactggcaagctagagtgcggtagaggatagcggaattcctggtgtagcagtgaaatgcgtagagatcaggaggaacatccgtggcgaaggcggctatctgggccagcactgacactgaggcacgaaagcgtggggagcaaacaggattagataccctggtagtccacgccctaaacgatgcgaactggatgttgggctcaacttggagttcagtatcgaagctaacgcgttaagttcgccgcctggggagtacggtcgcaagactgaaactcaaaggaattgacgggggcccgcacaagcggtggagtatgtggtttaattcgaagcaacgcgcagaaccttacctggccttgacatgtcgagaacttggcagagatgccttggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatgggaaggacagagggctgcgaacccgcgagggcaagccaatcccagaaaccttctctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgcttgccacggtgtggccgatgactggggtgaagtcgtaacaaggtagccgtacc

SEQ ID NO: 2016 - DNA, 1548 bp, Xanthomonas campestris
agagtttggtcctggctcagagtgaacgctggcggcaggcctaacacatgcaagtcgaacggcagcacagtaagagcttgctcttacgggtggcgagtggcggacgggtgaggaatacatcggaatctactctttcgtgggggataacgtagggaaacttacgctaataccgcatacgacctacgggtgaaagcggaggaccttcgggcttcgcgcgattgaatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccatccatgccgcgtgggtgaagaaggccttcgggttgtaaagcccttttgttgggaaagaaaagcagtcggttatacccgattgttctgacggtacccaaagaataagcaccggctaacttcgcgccagcagccgcggtaatacgaagggtgcaagcgttactcggaattactgggcgtaaagcgtgcgtaggtggtggtttaagtctgttgtgaaagccctgggctcaacctgggaattgcagtggatactgggtcactagagtgtggtagagggtagcggaattcccggtgtagcagtgaaatgcgtagagatcgggaggaacatccgtggcgaaggcggctacctggaccaacactgacactgaggcgcgaaagcgtggggagcaaacaggattagataccctggtagtccacgccctaaacgatgcgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggtcttgacatccacggaactttccagagatggattggttgccttcgggaaccgtgagacagtgctgcatggctgtcgtcagctcgtgtcgtgagatgttgggttaagtcccgcaagagcgcaacccttgtccttagttgccaagccaacgtaatggtgggaactctaaggagaccggccgtgacaaaccggaggaaggtggggatgacgtcaaagtcaatcatggccacttacgtccagggctacacacgtactacaatggtagggtacagagggctgcaaacaccgcgagggtaagccaatcccagaaaccctatctcagtccggattggagtctgcaactcgactccatgaagtcggaatcagctagtaatcgcagatcagcattgctgcggtgaatacgttcccgggccttgtacacacacagcaccgtcacacatgggagtttgttgcaccagaagcaggtagcttaaccttcgggagggcgcttgccacggtgtggccgatgactggggtgaagtcgtaacaaggtagccgtatcggaaggtgcggctggatcacctcctt

SEQ ID NO: 2017 - DNA, 1301 bp, Xanthomonas sp.
  kmd_489
gaatctaccgttttcgtgggggataacgtagggaaacttacgctaataccgcatacgaccttagggtgaaagcggaggaccttcgggcttcgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaagggtgcaagcgttactcggaattactgggcgtaaagcgtgcgtaggtggttgtttaagtccgttgtgaaagccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacaggattagataccctggtagtccacgccctaaacgatgcgaactggatgttgggtgcaacttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggtcttgacatccacggaactttccagagatggattggtgccttcgggaaccgtgagacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatggttaggacagagggctgcaaactcgcgagagtaagccaatcccagaaacctaatctcagtccggattggagtctgcaactcgactccatgaagtcggaatcgctagtaatcgcagatcagcattgvtgtcggwgaatacgttcccggggcgtttgtacacaccgcccgtcactccwtacaagtt

SEQ ID NO: 2018 - DNA, 1471 bp, Xenophilus aerolatus
cacatgcaagtcgaacggtaacaggtcttcggatgctgacgagtggcgaacgggtgagtaatacatcggaacgtgcccagtcgtgggggataactacgcgaaagcgtagctaataccgcatacgatctatggatgaaagcgggggatcgcaagacctcgcgcgattggagcggccgatggcagattaggtagttggtggggtaaaggctcaccaagccgacgatctgtagctggtctgagaggacgaccagccacactgggactgagacacggcccagactcctacgggaggcagcagtggggaattttggacaatgggcgcaagcctgatccagccatgccgcgtgcaggatgaaggccttcgggttgtaaactgcttttgtacggaacgaaaagtctctttctaataaagagggatcatgacggtaccgtaagaataagcaccggctaactacgtgccagcagccgcggtaatacgtagggtgcaagcgttaatcggaattactgggcgtaaagcgtgcgcaggcggtgatgtaagacagttgtgaaatccccgggctcaacctgggaactgcatctgtgactgcatcgctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacaggattagataccctggtagtccacgccctaaacgatgtcaactggttgttgggaattcactttctcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaatttgccagagatggcttagtgctcgaaagagaaccgtaacacaggtgctgcatggctgtcgtcagctcgtgtcgtgagatgttgggttaagtcccgcaacgagcgcaacccttgtcattagttgctacattcagttgggcactctaatgagactgccggtgacaaaccggaggaaggtggggatgacgtcaagtcctcatggcccttataggtggggctacacacgtcatacaatggctggtacaaagggttgccaacccgcgagggggagctaatcccataaagccagtcgtagtccggatcgcagtctgcaactcgactgcgtgaagtcggaatcgctagtaatcgtggatcagaatgtcacggtgaatacgttcccgggtcttgtacacaccgcccgtcacaccatgggagcgggttctgccagaagtagttagcctaaccgcaaggagggcgattaccacggcagggttcgtgactggggtgaagtcgtaacaaggtagccgtatcggaaggtgcggctgga

SEQ ID NO: 2019 - DNA, 1504 bp, Yersinia aldovae
gagtttgatcttggctcagattgaacgctggcggcaggcctaacacatgcaagtcgagcggcagcgggaagtagtttactactttgccggcgagcggcggacgggtgagtaatgtctgggaaactgcctgatggagggggataactactggaaacggtagctaataccgcatgacctcgcaagagcaaagtgggggaccttcgggcctcacgccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggcaatcgtgttaatagcacggttgattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgcgcttaacgtgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacagaacttagcagagatgcttcggtgccttcgggaactgtgagacaggtgctgcatggctgtcgtcagctcgtgttgtgaaatgttgggttaagtcccgcaacgagcgcaacccttatcctttgttgccagcacgtaatggtgggaactcaagggagactgccggtgacaaaccggaggaaggtggggatgacgtcaagtcatcatggcccttacgagtagggctacacacgtgctacaatggcagatacaaagtgaagcgaactcgcgagagccagcggaccacataaagtctgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtagccg

SEQ ID NO: 2020 - DNA, 1419 bp, Yersinia aleksiciae
cacatgcaagtcgagcggcagcggggagtagtttactactctgccggcgagcggcggacgggtgagtaatgtctggggatctgcctgatggagggggataactactggaaacggtagctaataccgcatgacctcgcaagagcaaagtgggggaccttcgggcctcacgccatcggatgaacccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggcagtcgtgttaatagcacgattgattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgcgcttaacgtgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaatttagcagagatgcttaagtgccttcgggaaccgtgagacaggtgctgcatggctgtcgtcagctcgtgttgtgaaatgttgggttaagtcccgcaacgagcgcaacccttatcctttgttgccagcacgtaatggtgggaactcaagggagactgccggtgacaaaccggaggaaggtggggatgacgtcaagtcatcatggcccttacgagtagggctacacacgtgctacaatggcagatacaaagtgaagcgaactcgcgagagcaagcggaccacataaagtctgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccac

SEQ ID NO: 2021 - DNA, 1461 bp, Yersinia bercovieri
attgaacgctggcggcaggcctaacacatgcaagtcgagcggcagcgggaagtagtttactactttgccggcgagcggcggacgggtgagtaatgtctggggatctgcctgatggagggggataactactggaaacggtagctaataccgcatgacctcgtaagagcaaagtgggggaccttcgggcctcacgccatcggatgaacccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcatccatgccgcgtgtgtgaagaaggccttcgggttgtaaagcactttcagcgaggaggaaggcagtcgtgttaatagcacgattgattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgcgcttaacgtgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacagaacttagcagagatgcttcagtgccttcgggaactgtgagacaggtgctgcatggctgtcgtcagctcgtgttgtgaaatgttgggttaagtcccgcaacgagcgcaacccttatcctttgttgccagcacgtaatggtgggaactcaagggagactgccggtgacaaaccggaggaaggtggggatgacgtcaagtcatcatggcccttacgagtagggctacacacgtgctacaatggcagatacaaagtgaagcgaactcgcgagagcaagcggaccacataaagtctgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactgg

SEQ ID NO: 2022 - DNA, 1546 bp, Yersinia enterocolitica
ttaaattgaagagtttgatcatggctcagattgaacgctggcggcaggcctaacacatgcaagtcgagcggcagcgggaagtagtttactactttgccggcgagcggcggacgggtgagtaatgtctgggaaactgcctgatggagggggataactactggaaacggtagctaataccgcataacgtcttcggaccaaagtgggggaccttcgggcctcacgccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggcataaaggttaataacctttgtgattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgcgcttaacgtgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaatttagcagagatgctttagtgccttcgggaaccgtgagacaggtgctgcatggctgtcgccagctcgtgttgtgaaatgttgggttaagtcccgcaacgagcgcaacccttatcctttgttgccagcacgtgatggtgggaactcaaaggagactgctggtgataaaccggaggaaggtggggatgacgtcaagtcatcatggcccttacgagtagggctacacacgtgctacaatggcagatacaaagtgaagcgaactcgcgagagcaagcggaccacataaagtctgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttac

SEQ ID NO: 2023 - DNA, 1461 bp, Yersinia frederiksenii
attgaacgctggcggcaggcctaacacatgcaagtcgagcggcagcggaaagtagtttactactttgccggcgagcggcggacgggtgagtaatgtctgggaaactgcctgatggagggggataactactggaaacggtagctaataccgcatgacctcgcaagagcaaagtgggggaccttcgggcctcacgccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggggttgagtttaatacgctcaatcattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgcgcttaacgtgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacagaacttagcagagatgcttcggtgccttcgggaactgtgagacaggtgctgcatggctgtcgtcagctcgtgttgtgaaatgttgggttaagtcccgcaacgagcgcaacccttatcctttgttgccagcacgtaatggtgggaactcaaaggagactgccggtgacaaaccggaggaaggtggggatgacgtcaagtcatcatggcccttacgagtagggctacacacgtgctacaatggcagatacaaagtgaagcgaactcgcgagagcaagcggaccacataaagtctgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactgg

SEQ ID NO: 2024 - DNA, 1461 bp, Yersinia intermedia
attgaacgctggcggcaggcctaacacatgcaagtcgagcggcagcgggaagtagtttactactttgccggcgagcggcggacgggtgagtaatgtctgggaaactgcctgatggagggggataactactggaaacggtagctaataccgcatgacctcgtaagagcaaagtgggggaccttcgggcctcacgccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggcagtcgtgttaatagcacgattgattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgcgcttaacgtgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacagaacttagcagagatgctttagtgccttcgggaaccgtgagacaggtgctgcatggctgtcgtcagctcgtgttgtgaaatgttgggttaagtcccgcaacgagcgcaacccttatcctttgttgccagcacgtaatggtgggaactcaagggagactgccggtgacaaaccggaggaaggtggggatgacgtcaagtcatcatggcccttacgagtagggctacacacgtgctacaatggcagatacaaagtgaagcgaactcgcgagagcaagcggaccacataaagtctgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactgg

SEQ ID NO: 2025 - DNA, 1543 bp, Yersinia kristensenii
aattgaagagtttgatcatggctcagattgaacgctggcggcaggcctaacacatgcaagtcgagcggcagcgggaagtagtttactactttgccggcgagcggcggacgggtgagtaatgtctgggaaactgcctgatggagggggataactactggaaacggtagctaataccgcatgacctcgcaagagcaaagtgggggaccttcgggcctcacgccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaagggttcagtgttaatagcactgagcattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgcgcttaacgtgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacagaacttagcagagatgcttaggtgccttcgggaactgtgagacaggtgctgcatggctgtcgtcagctcgtgttgtgaaatgttgggttaagtcccgcaacgagcgcaacccttatcctttgttgccagcacgtaatggtgggaactcaagggagactgccggtgacaaaccggaggaaggtggggatgacgtcaagtcatcatggcccttacgagtagggctacacacgtgctacaatggcagatacaaagtgaagcgaactcgcgagagcaagcggaccacataaagtctgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttac

SEQ ID NO: 2026 - DNA, 1461 bp, Yersinia mollaretii
attgaacgctggcggcaggcctaacacatgcaagtcgagcggcagcggaaagtagcttgctactttgccggcgagcggcggacgggtgagtaatgtctgggaaactgcctgatggagggggataactactggaaacggtagctaataccgcatgacctcgcaagagcaaagtgggggaccttcgggcctcacgccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcatccatgccgcgtgtgtgaagaaggccttcgggttgtaaagcactttcagcgaggaggaaggcagtcgtgttaatagcacgattgattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgcgcttaacgtgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacagaacttagcagagatgcttcggtgccttcgggaactgtgagacaggtgctgcatggctgtcgtcagctcgtgttgtgaaatgttgggttaagtcccgcaacgagcgcaacccttatcctttgttgccagcacgtaatggtgggaactcaagggagactgccggtgacaaaccggaggaaggtggggatgacgtcaagtcatcatggcccttacgagtagggctacacacgtgctacaatggcagatacaaagtgaagcgaactcgcgagagccagcggaccacataaagtctgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactgg

SEQ ID NO: 2027 - DNA, 1587 bp, Yersinia pestis
taaattgaagagtttgatcatggctcagattgaacgctggcggcaggcctaacacatgcaagtcgagcggcagcgggaagtagtttactactttgccggcgagcggcggacgggtgagtaatgtctggggatctgcctgatggagggggataactactggaaacggtagctaataccgcatgacctcgcaagagcaaagtgggggaccttagggcctcacgccatcggatgaacccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggggttgagtttaatacgctcaatcattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgcgcttaacgtgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacagaatttggcagagatgctaaagtgccttcgggaactgtgagacaggtgctgcatggctgtcgtcagctcgtgttgtgaaatgttgggttaagtcccgcaacgagcgcaacccttatcctttgttgccagcacgtaatggtgggaactcaagggagactgccggtgacaaaccggaggaaggtggggatgacgtcaagtcatcatggcccttacgagtagggctacacacgtgctacaatggcagatacaaagtgaagcgaactcgcgagagccagcggaccacataaagtctgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctaacgatacgcattgcgcagtgcccacacagattgtctgat

SEQ ID NO: 2028 - DNA, 1546 bp, Yersinia pseudotuberculosis
ttaaattgaagagtttgatcatggctcagattgaacgctggcggcaggcctaacacatgcaagtcgagcggcagcgggaagtagtttactactttgccggcgagcggcggacgggtgagtaatgtctggggatctgcctgatggagggggataactactggaaacggtagctaataccgcatgacctcgcaagagcaaagtgggggaccttagggcctcacgccatcggatgaacccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggggttgagtttaatacgctcaatcattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgcgcttaacgtgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaatttagcagagatgctttagtgccttcgggaaccgtgagacaggtgctgcatggctgtcgtcagctcgtgttgtgaaatgttgggttaagtcccgcaacgagcgcaacccttatcctttgttgccagcacgtaatggtgggaactcaagggagactgccggtgacaaaccggaggaaggtggggatgacgtcaagtcatcatggcccttacgagtagggctacacacgtgctacaatggcagatacaaagtgaagcgaactcgcgagagccagcggaccacataaagtctgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttac

SEQ ID NO: 2029 - DNA, 1531 bp, Yersinia rohdei
agagtttgatcatggctcagattgaacgctggcggcaggcctaacacatgcaagtcgagcggcagcgggaagtagtttactactttgccggcgagcggcggacgggtgagtaatgtctgggaaactgcctgatggagggggataactactggaaacggtagctaataccgcatgacctcgcaagagcaaagtgggggaccttcgggcctcacgccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggccaatagcttaatacgctgttggattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgcgcttaacgtgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacagaacttagcagagatgcttcggtgccttcgggaactgtgagacaggtgctgcatggctgtcgtcagctcgtgttgtgaaatgttgggttaagtcccgcaacgagcgcaacccttatcctttgttgccagcacgtaatggtgggaactcaagggagactgccggtgacaaaccggaggaaggtggggatgacgtcaagtcatcatggcccttacgagtagggctacacacgtgctacaatggcagatacaaagtgaagcgaactcgcgagagcaagcggaccacataaagtctgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacct

SEQ ID NO: 2030 - DNA, 1488 bp, Yokenella regensburgei
tagagtttgatccatggctcagattgaacgctggcggcaggcctaacacatgcaagtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcgatacggttaataaccgtgtcgattgacgttactcgcagaagaagcaccggctaactccgtgccagcagccgcggtaatacggagggtgcaagcgttaatcggaattactgggcgtaaagcgcacgcaggcggtctgtcaagtcttatgtgaaatccccgggctcaacctgggaactgcattcgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaacttagcagagatgctttggtgccttcgggaaccgtgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagt

SEQ ID NO: 2031 - DNA, 1485 bp, Zimmermannella bifida
agagtttgatcctggctcaggacgaacgctggcggcgtgcttaacacatgcaagtcgaacgatgaagccttagcttgctttggtggattagtggcgaacgggtgagtaacacgtgagcaacgtgcccagaactctggaataaccgccggaaacggtggctaatactggataggtgccaaggccgcatggtctttggttggaaagatttttcggttctggatcggctcgcggcctatcagcttgttggtggggtaatggcctaccaaggcgacgacgggtagccggcctgagagggtgaccggccacactgggactgagacacggcccagactcctacgggaggcagcagtggggaatattgcacaatgggcgcaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaattccgaggctcaacctcgggcgtgcagtgggtacgggcagacttgagtgcggtaggggagattggaattcctggtgtagcggtggaatgcgcagatatcaggaggaacaccgatggcgaaggcagatctctgggccgttactgacgctgaggagcgaaagcatggggagcgaacaggattagataccctggtagtccatgccgtaaacgttgggcgctagatgtggggaccattccacggtttctgtgtcgtagctaacgcattaagcgccccgcctggggagtacggccgcaaggctaaaactcaaaggaattgacgggggcccgcacaagcggcgtagcatgcggattaattcgatgcaacgcgaagaaccttaccaaggcttgacatataccggaaacggccagagatggtcgcccccttttgggtcggtatacaggtggtgcatggttgtcgtcagctcgtgtcgtgagatgttcggttaagtccggcaacgagcgcaaccctcgtcctatgttgccagcacgttatggtgggaactcatgggatactgccgtggtcaacacggaggaaggtggggatgacgtcaaatcatcatgccccttatgtcttgggcttcacgtatgctacaatggccggtacaatgggctgcgataccgcgaggtggagcgaatcccaaaaagccggtctcagttcggattggggtccgcaactcgaccccatgaagtcggagtcgctagtaatcgcagatcagcaacgctgcggtgaatacgttcccgggccttgtacacaccgcccgtcaagtcatgaaagtcggtaacacccgaagccggtggcctaaccttttggggggagccgtcgaaggtgggatcggtgattaggactaagtcgtaacaaggtagcc

SEQ ID NO: 2032 - DNA, 1482 bp, Zymomonas mobilis
agagtttgattctggctcagaacgaacgctggcggcatgcttaacacatgcaagtcgaacgaaggcttcggccttagtggcgcacgggtgcgtaacgcgtgggaatctgccttcaggtacggaataactaggggaaactcgagctaataccgtatgatatcgagagatcaaagatttatcgcctgaagatgagcccgcgttggattagctagttggtagggtaaaggcttaccaaggcgacgatccatagctggtctgagaggatgatcagccacactgggactgagacacggcccagactcctacgggaggcagcagtggggaatattggacaatgggggaaaccctgatccagcaatgccgcgtgagtgaagaaggccttagggttgtaaagctcttttacccgggatgataatgacagtaccgggagaataagctccggctaactccgtgccagcagccgcggtaatacggagggagctagcgttgttcggaattactgggcgtaaagcgtacgtaggcggtttaataagtcaggggtgaaagcccagagctcaactctggaactgcctttgagactgttagactagaacatagaagaggtaagtggaattccgagtgtagaggtgaaattcgtagatattcggaagaacaccagtggcgaaggcgacttactggtctatagttgacgctgaggtacgaaagcgtgggtagcaaacaggattagataccctggtagtccacgccgtaaacgatgataactagctgtccgggtacatggtatctgggtggcggagctaacgcattaagttatccgcctggggagtacggtcgcaagattaaaactcaaagaaattgacgggggcctgcacaagcggtggagcatgtggtttaattcgaagcaacgcgcagaaccttaccagcgtttgacatcctgatcgcggaaagtggagacacattctttcagttcggctggatcagagacaggtgctgcatggctgtcgtcagctcgtgtcgtgagatgttgggttaagtcccgcaacgagcgcaaccctcacctctagttgccatcattaagttgggcactttagaggaactgccggtgataagccggaggaaggtggggatgacgtcaagtcctcatggcccttacgcgctgggctacacacgtgctacaatggcggtgacagagggccgcaagcctgcaaaggttagctaatctcaaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgctgcgctaacccgcaagggaggcaggcgaccacggtgggtttagcgactggggtgaagtcgtaacaaggtagccgtaggggaacctgcggctggatcacctccttt

SEQ ID NO: 2033 - DNA, 20 bp, Artificial Sequence
  Description of Artificial Sequence: Synthetic primer
agrgtttgatcmtggctcag

SEQ ID NO: 2034 - DNA, 22 bp, Artificial Sequence
  Description of Artificial Sequence: Synthetic primer
tacggytaccttgttaygactt

SEQ ID NO: 2035 - DNA, 60 bp, Artificial Sequence
  Description of Artificial Sequence: Synthetic oligonucleotide
aatgatacggcgaccaccgagatctacactatggtaattgtgtgccagcmgccgcggtaa

SEQ ID NO: 2036 - DNA, 24 bp, Artificial Sequence
  Description of Artificial Sequence: Synthetic primer
caagcagaagacggcatacgagat

SEQ ID NO: 2037 - DNA, 32 bp, Artificial Sequence
  Description of Artificial Sequence: Synthetic primer
agtcagtcagccggactachvgggtwtctaat

SEQ ID NO: 2038 - DNA, 31 bp, Artificial Sequence
  Description of Artificial Sequence: Synthetic primer
tatggtaattgtgtgccagcmgccgcggtaa

SEQ ID NO: 2039 - DNA, 32 bp, Artificial Sequence
  Description of Artificial Sequence: Synthetic primer
attagawacccbdgtagtccggctgactgact

SEQ ID NO: 2040 - DNA, 32 bp, Artificial Sequence
  Description of Artificial Sequence: Synthetic primer
agcagttgaatatagtggtttagttagagttg

SEQ ID NO: 2041 - DNA, 26 bp, Artificial Sequence
  Description of Artificial Sequence: Synthetic primer
catgcttttttagtttctggattgaa

SEQ ID NO: 2042 - DNA, 30 bp, Artificial Sequence
  Description of Artificial Sequence: Synthetic probe
  5' 6FAM
  3' MGB
catccagtctcaattgtatatgtttctcca

SEQ ID NO: 2043 - DNA, 1541 bp, Escherichia coli
aaattgaagagtttgatcatggctcagattgaacgctggcggcaggcctaacacatgcaagtcgaacggtaacaggaagaagcttgctctttgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactcgtgcccaggcatgcgcaggaatacggaggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactcacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgmcacaccatgggagtgggttgcaaaagaagtaggtagcttaaccttcgggagggcgcttaccactttgtgattcatgactggggtgaagtcgtaacaaggtaaccgtaggggaacctgcggttggatcacctcctta
